United States Patent 10,695,415 (LIVE ATTENUATED ORAL VACCINE AGAINST SHIGELLOSIS AND TYPHOID FEVER) - sequence listing, part 2

SEQ ID NO: 1 - DNA, 4795536 bp, Artificial Sequence (residues 1,598,513-3,197,024 of 4,795,536)
  Ty21a-YBC, clone #1-28
aatcacggcgtacaaaaacggcgtcgaatgacctataccgccgctaatcagtaaaggaacgccttgcgctttggcgatgcgacaggccgcgtcgatagtggggatcaccgcattgcccgccaggacgacgcaatccgacgaataaggttgttcgccggaaaaatcattttgcgccagccactgtccgacggtattcaccgccagcaatgtttccgcagagagcgccggaaatggcgttgtattcataattcctcctttttgttccgaacttgtaccggatctctttgaaagatatcgtcgcctggctttttaggccgtaatctgatccatggcctgtaaaatacgcttatcggaaataggataaggcgtaccgagctgttgggcgaaataactgacacgcagttcttcaatcatccaacggatctctttaacatcatcatcttcgcgacgcgctggaggcaatttatttatccattgttgccacgcctgctggacgctttcgactttcagcatttgctcccgatcgcggtgcggatcgacagccagtttctccagccgcttttcaattgcctgcagataacgcagcgtatcgccgagacgtttaaagccgttgccagtcacaaaaccacggtataccagaccgctcatctgcgccttgatatcggaaagccccaacgccatgctcatatccacccgccctttcagacgcttattgatattgaatacggtcgtcaggatccgctcaacctgcttcgcgatatccaccacagtatcattcagctcggcgcgtaccttttcgtgcagcgcggtgaaacctgcttcgctccacaccggcccgccgttggcatctatcagcttatctaccccgcaggcgatacagtcatcaatcaactccagtactttgccgtacgggttaaagtacagccccagcttggctttattcggcaatttctcatgcagatacttaatcggtgaaggaatattgagcaacagcagacggcgtaaaccgcaccacatcgcctgttgttgttccagcggattatcaaacaatttgatagcgacgctgtcacgctcatccactaacgccggccacgccttcactttataattaccgcgtttctgttcgtagctttccggcagctcgccgaaactccagatatgcagcccgctctgctcgatgccgtcatccgctaccgccgagagcgtctcctgcactttgcctttcagcgcatttttaagctcggcgagcgaacgcccttcctgcagtttcttgtttttgtcattcaccacgcgaaacgtgattttcagatgctcgggcacctgatcccaatgccagtcttcccgatcgaccgtgacgccggtcatccggcgcagttcacgctccagagcgtccagcagcggcagctccagcggcgttacgcgacctaaaaacgcttcagcatagtttggcgccggaacaaagttgcgacgtaccggttttggcaacgatttaatcagcgcaatcactaattcacggcgcagccctgggatctgccattcaaaaccgctctcgtcaacctggttaagtagcggcaacggaatatggacggtcacgccgtcagcatccgcgcccggttcaaactgatagctcaaacgcagcttgagattgccctggtgccagaaattcgggtaatccagtttgctgattttttccgcgccttctttaatcagcatacttttttcaaagttgagcagatccggcgtctcgcggctgatttttttccaccaactatcaaagtggcgggcggaaataacgtcatggctaatacgctggtcataaaactcaaacagggtatcgtcatccaccaggatatcgcggcggcgagatttgtgctcaagttcctcgacttccgcacgcaattttagattctcacggaagaaggcgtgacgggtttgccagtccccctccaccagcgcatggcggataaacaactcgcgacacaacgccgggtcaatctggctataattcaccttgcgcgcggcgacaatcggcagaccgtagacagtaaccttttccgtcgccatcaccgcgccttgcgcccgctcccagtgcggttcgctatatgaacgtttaatcaggtgctgggctaccggttccacccattctggctcaatgcgggcagcgatgcgcccccacaaacggctggtttccaccagctcggcgaccattgtccatttcggcggttttttgaataaaccggatccggggaaaatagagaatcgggcgttacgcgcgccggtgtactcttgtttatcggcatctttcatcccgatatgcgacaacagccccgttaacaacgcaacgtgaatttcccggtattctgcgggttcgctgtttaccggaatccccagttcttttaccacctgacgcagttgggtatagatatcctgccactcacgcacgcgtaaatagttcagatagtcggtgcgacacagacggcggaattgattcgacgacagggccttttgttgctcgccgaggtaattccacaggttaacaaacgccagaaaatcggattccttatcatggaaacgccggtgtttctcatcggaagcctgctgcttatccactgggcgctcgcgcggatcctgaatagagagtgcggaagtaatgatcatcgcttcgcgcacacagccatgtttttgcgcttccagaaccatacgcgccaggcgcgggtcgaccggcaactgggataattgtcggcccagcggcgtcagcttatatgccgtttgctgttcgtcggcggtaatcgcccccagctcttccaacaaacgcacgccatcctgaatattgcgcttatccggcgcttcgacaaacgggaaggcggctatgtcacccagtcccagggcggtcatctgcaaaataaccgacgccaggttggtacgtagaatttccgggtcggtaaattccgggcgtgacaaaaagtcatcttccgaatacagacgaatgcagatcccttccgatacgcgtccgcaacgccctttacgctgattggcggaagcctgtgagatcggttcaatcggcaggcgctgcactttagtgcggtagctgtagcggctgatgcgcgcagtgccaggatcgatcacatatttgatacccggcaccgtcagcgaggtttccgccacgttagtcgccagcacgatacggcgtccgctgtgcgactggaaaacgcggttctgttcgctgttcgacaagcgtgcatacagcggcaacacttcggtatgccgtaagttcagcttgttcagggcatcggcggtatcgcggatttcccgctctccgctcataaaaatcaggatatcgccaggactttcacgccccagttcatcaacagcgtcgaaaattgcctgtagctgatcgcgttcagtgtcgtcagcctcttccacgatggggcgataacgaacttctacgggatacgttcggccagagacttcgataatcggcgcgttattaaagtggcgcgagaagcgttccgggtcgatggtcgcagaggtaataatcactttcagatcggggcgacgcggcagaagctctttcagatagccgagcaagaagtcaatattcaggctgcgttcatgcgcttcatcaataatgatggtgtcgtactgcatcaatagcctgtcctgctggatttccgccagcaggataccgtccgtcatcagtttgaccatggtgttgctactgacatgatcgctgaaacgaactttatagccgatgcagccgccaggctccgtttgcaactcttcggcaatgcggttagcgacggtgcgcgccgccagacgacgcggttgagtatgtccaataagtcctttaattccgcgtcccagttccatacaaattttcggcaactgggtggttttaccggaaccggtttcccctgccacgatcaccacctgatgatcgcggaccgcttccagaatgtcctgtttcttctggctaacaggcagattttgcggataagtgattgaggggcgcgccgcttcgcggagagcgacctgcgtcgcagcctgttcaatttctttcgccatcgtctggaaaatggcctgttgcgcatcaggattttttactttctttacgccatgcaggcggcgcgaaaagcgctgtttgtcgcgcagcatcagtgcatccagccgctgctgtaacacctgaagcgtcaacgtagattgttcagtcataaagctcttgggcagcattctgcctgtttaaaatcgttttaaatgataggtatagagtaccacattggggctttttttgtgttgttcaataatttcgaacaaagggttcgatatattgcgctatccctgcgacatatttgtgaataaagtgtcaacaagcaacggggcacgccccttcaaacacataaaaggaaacacccatgagcaaggtattagttcttaaatccagtattctggcagggtactctcagtctggtcagttgactgactattttattgaacaatggcgcgaaaaacacgtcgcagatgaaattactgtccgcgatctggcggccaaccctgttccggtgctggatggcgagctggtgggcgcgatgcgtccgggcgatgcgcctttaacgccacgtcagcaggacgctctggcgctgtctgatgaactcattgctgaactgaaagcccacgacgtcatcgttattgcggcaccgatgtacaatttcaatatcccgacgcagctgaaaaactactttgatctgattgcccgcgccggtatcactttccgctataccgaaaaaggcccggaaggtctggtaaccggcaaacgcgcggtggttctctccagccgcggcggtatccataaagacaccccgacggatttgattgcgccttacctgaaagtgttccttggttttatcggtatcaccgacgtgaattttgtctttgccgaaggcatcgcctacgggccggaagtggcagctaaagcccaggccgatgcaaaagccgcgattgacagcgtcgtggccgcttaaatatttttgcctcccgtttcgacgggaggtgacttcttaggttcgtagcgcaaatatcctaccacgccgctactgccgccatcgctgggatgcgttaccccatcattgacttcaacgcaggcgaaatcaaaaggcgacacattttcaatgcacgccacattgaccccatattgatcgggattggatcggcgctgatgaaaagtatatatcccgcataccgaacagaaaaaatgcaccgccttgcccgtattgaagcgatattcggtaagcttatcctgcccttttagcactttaatacccgatagcggcgcagacactgccaccgctccgcgcatccggcaaaacgaacagttgcagcgcctggcggtatgaaagccatcgctaagttgaacggtaaacacgacgctgccacaatggcaggcagcagataatttttcagacgtcatacctggttactcacgcgaatagtgataccagtcgacagtatagaaatagccttccggttcgcctaatgtaaatacgacctccgtattcaaaaattacccatataaaaatgcattttgcggtaaaaaaattgtcgggaagcggttatttacgcatccatttgccattaattccctggacatattctcccggcctggcgcgcttaaccagtttttgccctgccatcttcgccacctcatccacgggaagatgattgctatccgctaactgctgataactggcgcgacgggcatgattgatatcaagcaccagcttctgggtttcggcatcattctttaaggccaccagatagccattcagcgtttccccgacccggccctgcgtgcgcgcttcgtccagggttaaggcccacacagaaggtgtgagcaagctcagcgtcagcacccatagtattaaatactttttcattatggcctcagaatagatcgctgcgtgatttcaggagttcttcaacgtctttatcgactttgatatgtatttcatgctcgatctttacattcatgttgatggtaatcggctgttccggcgcggcgacttcaatacgtggcgtgcaccccaccacgataaatgacgcaagcgctgacagcatggcaatactcattttcattatttatcctcacagtccttgtctttccggcaaggaggttgcggcaacgctgtattttgttcaagccatgcctgtaaattgtcgccaaaacgcaaactgcgccacagcgtaaacacattttcttcatgggtatagttcaagttaacgatcgcggttttaccatctacccggcttttgccggtaatggccgcctgcatcgttagtacgcccaggttatcaacgttaatttttgtccacgaatgcgtaatctccatataacgtagccagttaatcgccgagcctgccgtgacattatccttcaccaccgcatccgcagtatctttatcgatacgcaacgtcattgggcccaggattcgtaagccagccatctttgattatccatttttcattgttcagccacagcggcagcgcgccgctaaccggaccagacatggcgaattgctttggatttatggcgctaatcaattcgctggatgaaatattttgcacccgcaaaagcgccgggtcgtgctgcggcattcgcaactgtttcataataatttgaccgcccagcacgtctacgctgacatcgcttagcagtaatggattcgactcgctccagggataaccgccctgtaaatcggcggtgatatttttcgccgtgacctggttgactatcccggcaatacgcagcgagacgggcccgcgcgtccccaattgccacgcgccgttgtggaagcgaaatggcagaatgaaatcgacgccgttgattttgttatccggcatccaggcgctaccgccctttaacacgccgtgtccacctgcttcaaatccctgcccctgcgcagcggaaaaagccacctgcgcatacagtgagccttcgcgcagcgtcattttccagtccggtggaagcaacggctggaaaacgataagcgactgcttcggccaccaggcctgtccgcgaaggcgttcgccatcccagcgcccgttcagccgtaccggccctatcgcccccgcccgaaggtcgcctttaaactggaacagggttggctcgcgcccttcaacgctaaaattaagggtagaaggcggcagcacgctcccgctggtaaatacggtttttcccgcctccagagacagcgcgccctgtagcgacggcgttgtggcgtcgcgaacccagacaataggtttatccagcgccagtcttggcgatgtgacggtcattgcgccatagtgcaactgatcaaaaccggtggacaaactggtcaacctgatggtgttatcatgccattcgccctgtccggcaatatcccagcgggcgcgcattggcgtaaagcttccttgcccccaatagcgccaccgccagcgaccagcatcagggagaaaatcattggccaggccatcaagatgaagaacgaaatcgcccatctcattttcgtgcgcccgtaaaatagcctgtaatcgaccatcaacgccgcgcggcgttaccttaacgcccgccagcggccaacgaatttcatcaatatctaacgcatcaatcacccgtccgcgtgagcgtagcaatgcgccaggtgcaaaggtgagctgcggatcggccagactgccgcggaacatagcgggcaatacggcataaaagattaaatccttctgtttagcctcgccggtaagctgtagaggcatctcactgctatccatgctgagttttcccgggccgatagtcagtaccgcgttcgctttaccggcatcgccctgggtcagaatattcaggcgtccgctgactcgcgcattatccggcccggcttgccagttatcgatattaaaagccagacgtccgctcaaggggaatccctgatatggccagttccagcggccatcgctgacggtaagccgctgacgcgttaccgcccaggggagatcgagaatcggatcaggattacctcgcgccatcacgatgagctgtccggcattatcacgccactccagttccgcatccaccagcgacggttcctgcggcagacgcaaggtcgctgccgcatgaccgctgaccggcaggccatccggtaccagcggcaacataaactcccccgccaggctaacgggaggctggttggccagcgcggcgatctccagttggctcaccgtcaatgcctgaccgcgtagctgcccttgaaattttactttttcgccctgataacgtatctgctgaatgaccggcgtcatggagatcgccagcttgccctgccattccggccagggcgcgagaatgacattatcgatgttaatccaggtattgggcagcattgactgccactgcgccagcgtacgcggcgcggcgggagaagcttccgaagccggcagtttcgccaggcatgcggcatccagtttgaggcttttaatattcagcaaccaacggctgggatgcgtcagttccgcctgggtaatatgcgctaacgaacaatcattgaccagatagcgaagatcgggaatcactaacccatgacgtgtcaggcgtggactttgttccagagcgatacgggtaccgacgggtagccaaattcccgccagagtgggaacccacagcccgagggtcatcagtagcgtcagagggacaagaatcagcagtaacagtagcgcaagggcggctttatatttacccttcatgggccattaatttcctgatttaacgaaaaattcagtcggctatctctttattttggcatgattgcccgtacatagcctaatagttcatgttgcaaacgggtgatacgttatgcgtgttgcagggccgccctccgactatttgaggcgtcgtggagaatgataacctaaaattattcatcatatgtatgactatcaattatttttgattttttgtaagataattttaagcatatttgtgtgattctaacatcactggagaaggtcatatgaaactcgccgtctatagtaccaaacagtatgacaagaaatatctacagcaagtgaacgaagcgttcggttttgaactggagttttttgattttctgctaaccgagaaaacggcgaaaaccgccaatggatgtgaagcagtttgtatcttcgtgaatgacgacgggagccgaccggtactggaagagctgaaaaaacacggcgtgaaatacatcgcgctgcgttgcgccggatttaataatgtcgacctggatgccgctaaagaactcggcttgcaggtggtgcgcgtaccggcttattctccggaagccgtcgctgaacatgcgattggcatgatgatgacattgaaccgccgtattcaccgcgcttatcaacgcacccgcgacgctaacttttcccttgagggactgaccggctttaccatgcacggaaaaaccgctggcgtcattggtaccggtaaaatcggcgtcgccgcgctgcgtatcctgaaaggctttggaatgcgtttactggcgtttgatccctatcccagcactgccgcgcttgacctcggcgtcgagtatgtggatctgcaaacgttgtttgccgaatcggatgtcatttccctgcactgcccgctcacgccggaaaactaccatttactgaaccatgcggcattcgatcaaatgaaaaatggcgttatgatcattaataccagtcgtggcgcgctgattgattcccaggcggctatcgaagctctgaagaatcagaaaatcggctcgctggggatggatgtgtatgaaaacgaacgcgacctgttctttgaggacaagtcaaacgatgttattcaggatgatgttttccgccgtctgtcggcctgccataacgtactgtttacggggtatcaggcattcctgaccgcagaagcgctgatcagcatctctgaaaccacgttacaaaacttaagccagcttgagaagggcgaagcctgcccgaacgcgctgttctaatcctgtcgctcccctgcgctcagaggagcattttcggataacccctgaagatctatccggtcatatcattactatagtcagtgttaactatcagattacagagaatatcaatgaagaaaatcgtcacgctggtcgccctgagcatcataatgacagggtgtgtgagcagtggaaaagtgtccgtcaaacgcgagcaactggagcaccaccgctttgttctggaaagcgtaaacggtaaaacggtcaccggcccggagctcagctttggcgaggacatgacggtatccggcaaaatgtgcaatcaattcaccggcgaaggaaaactatcggacggcgaattaaaagtgaaaaatttagcgatgacccgaatgatgtgcgccgatccgcagcttaatgcgctggacggcaccctcagcgagctcttcagcaaaggagcgcaagtcgatttaactgcgaaccaattaacgctggcgacggcagaaacaacgctaatgtataaactggcggatttagcgcactaagccattaagtgaaaagttatacgcgtcaggcgaaacgccgcgcttaataactcccgcagcttccggcggcaagcgactgttcgctacaacgtttgccgttgggtagcgcgcacataccaattactgaaccatcaagctgccgggccgctgaaagcgaaccgccaatcatagcgcaattcgcttcgccggcgctggacatcgccgctttcatccctggcgaaacatgcgccgcagttgcctgctgaacaggttcgctactgcaagccgacaataataacgcggcacatcccacccaaaacgctgcgcgcatttctctcccctctgtttattcatccaaacgacaccgccctaaataataggcagcagaaactgacgcgtcgagaggcaaagcgcgcatttatgcgcttcattaacatttattggcaattttttacgtcttttcggcaagaaatcgccattctcctcccgccagggacacaaaagcgaaaatggggcttgaagggctttgctaaaataaaaggataactacaggatacgctcacgattatgcgtgtccctcttttttgcgcaatgtaagggtgtcatatgcaaacgattgacggtaatggcgcagtagcgtcggtggcgttccgtaccagcgaggttatcgccatttacccgattacgcccagttcaacaatggctgaacaagcggatgcctgggccggcaatgggcttaaaaatgtctggggcgatacgccgcgtgtggtagagatgcagtcggaaggcggtgcgatcgccgccgttcacggtgcgttacaaaccggttcgctttctacgtcatttacatcatcgcaggggctgctgctgatgatcccaacgctgtataaactggcggggcagctcacgccgtttgtactgcacgttgccgcacgcaccgtcgccacacacgcgctttctatttttggcgaccattccgatgtgatggcggtccgccagacaggctgcgcgatgttatgcgccgccagcgttcaggaagcgcaggattttgcgctgatcgcgcacagggctacgctgaaaagccgcgttccgtttattcatttttttgatggcttccgtacatcgcatgaaatcaacaaaattataccgctaacggatgaaaccattctgaacctgatgccgcaggcggagatcgacgctcaccgcgcccgcgcgctgaatccggagcatccggtgattcgtggaacttctgcgaatccggatacctacttccagtctcgcgaagcgaccaacccgtggtacaacgccgtttatgatcatgttgaagaggcgatgaaggcatttggcgatgctacaggccgccagtaccagccatttgaatattatggtcatccccaggctgaacgggtcatcattatgatgggctccgccctcggcacctgcgaagaggtcgtggacgagctactgatacgcggagaaaaggtcggcgttctgaaagtccgtctgttccgccccttctccgccaaacatttgttacaagcattaccggaaaccgttcgcgctatcgccgtgctggatcgcaccaaagagcctggcgcccaggccgagccgctttatctggacgtgatgaccgcactggcggaagcctttaataatggcgagcgcgaaacattgccgcgcaccattggcggccgttatgggctatcatccaaagagttcggcccggcgtgcgtactggcggtctttaatgaactcagccgcgcgaaacccaagccacggtttacggtgggcatttatgatgacgtcactaatctctcgctgccattaccggaaaataccctgcccggcagcgctaaactggaagcgttattttacggtctgggaagcgacggcagcgtatccgccacgaaaaataatattaaaattatcggtaattctacgccgtggtatgcgcaaggttatttcgtttatgactctaaaaaagctggcggactcacggtatcgcacctgcgcgtcagcgaaaaacccattcgttccgcttacttaattgctcaggcggattttgtcggctgccatcaattacagtttatcgataaatatcagatggcggagcgtctgaagccaggcggtatctttctgcttaatacgccgtacagcgccgacgaggtctggtcgcgtctgccgcaagaagttcaggcggtattgaatcagaaaaaggcgcgtttttacgtggtcaacgcggcgaaaatcgcccgcgaatgtggactgggcgcccgcatcaataccgtcatgcaaatggcgttcttccacctgacgcatattcttccgggcgatagcgctctggttgagctgcagggcgcgattgccaaaagctatagcagcaaaggtcaggatctggttgagcgtaactggcaggcattggctctggcgcaggaatcgctggcggaagtgccgttgcaggcggttaatccacacagcgcgcatcgcccgccggtcgtctccgacgccgcgccggatttcgtgaaaaccgttaccgccgccatgttggcgggcctcggcgacgcactgcctgtttccgcgctgccgccggacggaacatggccaatgggcaccacccgctgggaaaaacgcaatatcgccgaagagattcctgtctggaaagaggaactgtgtacacaatgtaatcactgcgtcgccgcctgccctcactcggcgattcgtgcgaaagtcgtttccccgcaggcgatggagaacgcgccagccagtctgcattcgctggacgtgaagtcccgcgatatgcgcggccagaaatatgtgctgcaggtcgcgccggaagactgtactggctgtaatttatgcgtagaggtctgcccggctaaagatcggcaaaatccacagatcaaggcgattaacatgatgtcgcgccttgagcatgtggaagaagagaaagtgaattatgacttcttcctcgacttgccggaaatcgatcgcagcaaactggaacggattgatatccgcacatcgcagctcattacgccgctgtttgaatattccggcgcctgttccggctgcggtgaaacgccgtatattaaactgctgactcagttatatggcgacagaatgttaatcgctaacgccacggggtgttcctctatttacggcggtaacttaccctctacgccttataccaccgatgccaacggacgcggcccggcgtggacgaattcgctatttgaagataacgcggaatttggcctcggtttccgtctgagtgtggatcagcaccgggcgcgcgtcatgcgtttactggcgcaattcgccgatcgcattccggcggaattaaacgatgcgctgcatgccgaagcaacgcctgacgttcggcgtgaacaggtcgccgcattacgccaacatctgaaatcggttgcgggcgcagaggaactgttaaaaaatgctgatgcgctggtagaaaaatcaatctggctgattggcggcgatggttgggcatacgacatcggctttggcggtttagaccatgtgttaagcctgacggagaatgtcaatattctggttctggatacgcagtgttattccaatactggcggccaggcgtcgaaggcgacgccgcttggcgccgtcactaagtttggcgaacatggcaagcgtaaagcccgtaaagatcttggcgtcagcatgatgatgtatggtcatgtttatgtcgcgcaaatttcgctgggcgcgcagttaaaccagacggtgaaagccatccaggaggccgaagcctggccaggaccgtcgctgatcattgcctatagtccctgtgaggaacatggctacgatctggcgctaagccatgaccagatgcgccagttaacggcgaccggtttctggccgttataccgctttgatccccgccgtgcggatgaaggcaagccgccgctggcgctggactctcggccaccgtctgatgccctagcggaaacgttgcttaatgaacagcgtttccgtcgcctgaatgcgcaacagcctgaagtagctgaacaattatggcgagatgccgcattggatttgcaaaaacgctatgactttcttgccttgctggcaggaaaagcggaaaaacccagcgcagattaaaaaacattctaaggattaacctggaaataataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcgcaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaagcccgaacatccgttcgggcttgtcaatttatacgctggaaagcaaaggttaacgcaatggcccaacgacaaaatgaatatgtgacaataaaggcatataacaggcgtagaatatcgtaaccgaatgatattgtataatttttatttcgtataatacccctaaaagcattcgtataaattatatctatttcactgcgaattatttcattaattattgaattaaacggtaacatctctttttaggtctttcctgacaaggcagaaataacgttttaacgtcaactcgctgattatttacggggaatgcgcttaatattacgccgtcctcccctgttggtagtccccccagagtatcgtggagcagcacctaaaatgtgacgtatgtcattgtacataaagtgcctttagggagtagaatttcagtggatacttaaacaggaggttttatgaacagaacgattcttgtacccatcgatatttcagattcagaattaactcaacgcgtgatttcacatgttgaagccgaagcaaagattgacgacgctaaagtgcactttttgactgtaatcccgtctttgccctattacgcttcactgggactggcttattcagcagagctccccgcaatggacgatttgaaagccgaagccaaatctcaactggaagcgattatcaagaaattcaaccttcccgcggaccgcgtgcaggcgcacgtggcagaaggctctcctaaagataagattctggaaatggcaaaaaaattaccggccgatatggtgattatcgcctcgcatcgtccggatattactacctatctgttgggttccaacgccgcagccgttgtgcgtcatgcggaatgctccgtactggtggtgcgctaaatacccgagcccgcataagagagtgcgggctcaaatcaaccatcatcatcgcctagtgactgacgctttttgaaaacagattgattacgattacaccgcagatgataagcaacatgccaataatagccggcacatccaatttttggccaagaaacagccatcctatcaatccaataagaacaatccctaccccagaccaaatggcataaatgatacccgcagggatggttcgcatagggatggtaaggcaccagaacgcgatacaatatccgatgatggtaacgaggctcggtaccagacgcgtaaaactatccgataattttaatgagatcgtggcgataacttctaccacgatggcgataaatagaaagattacagcttctttagtcatacatctcttcgttccgatatttttctggtcgtggtgacatcttaattaatacggatgacagaataaagacgcttttgacccgttgcgtatctcgccataacctacttcaagttgcatgtgctgcggctgcgttcccttaccccagtcacttacttgagtaagctcctggggattcgctcgcttgccgccttcctgcaactcgaattaattaaagtataaaagcaacctttcatacacgagagataacaacaataaacctgttcaggatttatgattacttagaagcgtttgcctgccccgtattttctgctttaccatatgtcctgtcaattataccaacagggtccactggtgtgttttttggcataacccagccactttcactgacactacctcgtgtaagatatttgacttttaccctaacgataataagataatgttccctgctgaacctgtcggcaacactaagatcggtggtatattcaggtacgattcttccacttcgaacctgctctttggctatttcagcagagacaggcaatacctctacatcgccccctcaataccgcctgctgttttaaaactaacaatattttcagcctgcggacctattgtacctcggcataatacaacttcagtctcccctgctacagcatccccactctggtatttcttataaatactttgtacattttcttctgatgtagggtataaattttctgacagagaggccagtatatcttccagtaagggggaatcatccgtaatatccagaagctcttcatcataacccgtgtctccttctcttaactctgaataaggcttatcaatatggcgaataagccccccacctttcagccctgacgcctgataaaatcttccatcagaagatcggtaaaatgttatggctgaattttttccgctatccgaataggttgcctgatacgtttctgaaccgggttctttagttaaaacgagctctctgtcgccatattttatcgtattaggcgcttccgatgacagcggtggatatgaggcttgttttctgtagcgtccccctgccatagatgtaacgtgttcaaataggccatctaacaccttacctgccaggttaggctccgtagttggggcaggatgatcctccgggagagccctttcatatctctgtaattctttaacaggtaaaaaatcattctcaccctctgaattaccattttttatcctataatcaccagatgttactgctaatcttgatgataataacaaaccagttactgcaatgtttttaatactcctgtccattttatgaatggttactggctgaagatgattgcggctatgagaagataagaaaatttgcttttgaatttcctttccctcaaatataatttgctcagtgcttttaggtggaacagttacgctatctacattaaatagctcatgttcaccactcatcgttacctgagaaaaacacgacgatgtatgtgcaattgcagcgggatcaatctctttataaataacattggcgtaaacgtttgcaacttcaccgcttgcatttaaatgatcgtgcaaaatatgttttagaaatagatctaacaacattttttttgatgtgattccatttacacagttgtgaaagtcagggggaattggatagccgttttgatcaaatggaagcgataaacatcctcgccccccatcaatattttcgtaactgtaatttagagatatctttacctcgcatttattggtatctacatcgtcattgatactgcgctctactttataattaaccagcctacggaaggttgcgctatttgaataataaaaatccaatgttgattggatttcttcacatataatttcatgtgttggctcaaagaagaattcataaatatttaagctgttcttttcttcatctttggccatctcatccagcttaatatattcttctggtaaattagatatttgctcatgaaagatatcgtcctgataaagtccatccaacattgaaaggtacggtatggtatcccaacttctgatagcttgtatctgtaccgtctgctgtgattctctggttgatatatcacttactgttatacgcattacattctccagccagaattatggtatacatcataaggtgtagatatcaggtagcaattctcatcgcaaataatttgtctgaactgtacatatgatacaggctatttttaattcaatatgaccaccagaataggcaagaaaattttaaatagtatacggtaaaatgatcttacccaacgataattaaacacactgcactatcttattagataataaaatactgatacgttattttatatcaccaataaaagagcaaaaagggtgtgccgaatatcattttacacctgtcccggttcaccccacggaaccacttgaaacgtaccatcatcaggacgctgcagcgcctgaatttcagttgagcccgtcacttcttaacgggcctagctacatgatgtatacagttgacaatatccgaaggtactatctctattaaaacgtgctggcattcgtcgccgtaatccgtaccatacgcgacatacttttgcctgctggctgttgacggcaggagcgaacccggcatttatcgccagccaaatggggcatgaaactgcgcatatggtgtatgaaatttacggtatgtagattgatgacatgaacgacgaacaagtagcgatgttgaatgcgcggttatcgtagttgcaaagtttgcccccaatttgccccatttagtaccagagaactgaaataatgcaagaaattcaaaagaatacaaagaaagaacaatacaacctcaacaagttgcaaaagcgcctgcgccgtaacgttggcgaagcgattgccgattttaatatgattgaagaaggcgatcgcattatggtttgcctttctggcggcaaagatagctatacgatgctggaaattttacgtaatttgcagcaaagcgccccgatcaatttttcactggtcgccgtcaacctcgatcaaaagcagccaggttttccggagcatatcctgccagcctaccttgagcagctgggcgtagaatataaaatcgtcgaagaaaacacctacggcattgtgaaagagaagattccggaaggaaaaaccacctgctcgctgtgctcgcgtttgcgtcggggtatcctgtatcgtactgcgactgaactgggcgcgaccaaaatcgccctgggccaccatcgcgacgatattctgcaaaccctgtttctgaatatgttctatggcggaaaaatgaaagggatgccgccgaagctgatgagcgatgacggcaaacatatcgtgatccgcccgctggcttactgccgcgagaaagatattgtccgttttgctgaggccaaagcctttcctatcattccttgtaatctgtgcggttcgcaacccaacctgcaacgccaggtgattgccgacatgctacgcgactgggataagcgctatcctggacggatcgagacgatgtttagcgccatgcagaatgtcgtgccgtctcacctttgtgacacaaacctgttcgatttcaaagggataactcacggttccgaggtcatcgacggcggtgatttagcgttcgatcgtgaagagattccattgcagcccgctggctggcagccggaagaagatgacaccgccttagaggcgttgcggcttgatgttatcgaagtgaaataatctgcaggcgtctcagcactccgctgagacgccatactatcgatcattttaatagccgtacccggcatgacttgcctttgatcttcccgttttgcaactgcttccaggctttttgcgctactgcttgacgtacggcgacgtaaacgtgcatgggatgcacgttaattttgccaatatccgccccgtccaatccaatatcgccggtcagcgcgcctaaaatatctcccggacgcattttcgcttttttgccgccgtcaatgcatagggtagccatctctgcggccagagggagtaacggctgccgggcgggcgcattcagccagttcagcttgagttgcagcatttctgaaagaatattcgcccgctgcgcctcttccggcgcacagaaactgatcgccaggccgctgcttcccgcgcgcgccgtacggccaatacgatggacatgcacctccgggtcccaggccagctcatagttaaccaccagttcgagcgatttaatgtctaaccctcgcgcggcaacgtcggtggcaaccagaatgcgcgcgctgccatttgcaaaacgcaccaacgtctggtcgcggtcgcgttgttccagatcgccgtggagcgccaacgcgctttgtcctaccgcattaagcgcatcacaaacggcctgacaatcttttttggtattgcaaaacaccacgcaggacgctggctgatgctggctaagcaacgtttgtagcagcgaaattttttcatgcgccgacgtttcgaagaactgctgttcgatagccggtagcgcatctaccgtatcgatttcaatacgtattggctgctgctgtacacgaccgctaatcgccgcaatggcctcaggccaggttgctgaaaacaacaacgtctggcgcgtcgcaggcgcaaagcggatcacctcatcaatggcgtcactgaatcccatgtccagcattcggtctgcttcatccattaccagaatgtgcagcgcatccagcgatacggtttctttttgtaaatgatccagcaggcgccccggcgtcgcgacaatgatatgcggagcgtgctgaagcgagtcgcgctgtgcgccaaagggctgcccgccacacaaggtcagaattttggtatttggcagaaaacgggccaggcgacgtaactccccggctacctgatccgccagctcccgcgtcgggcacagcactaatgcctgtgtctggaacagagtgacatcaattcgatgcaagagcccaagaccaaacgccgccgttttaccgctaccggtcctggccttgcacacgcacatcattacccgccagaatgacgggtaatgctgcggcctggacaggcgtcatctcaagatagcccagctcagtaaggttattgagctgggcggcgggcaaaacattcagggttgaaaaagcggtcacaatttactctcgcggtaacgactcatagtcagcaggcgcgtatcctcgcagatccggacgtttgatgcgacattttaatcggttcttcgtccggcggcgggtcgggcatcggctgaggacggggaagcggctcaggaatgggaacagggtcagtgggaatcgggtccgacaaggacgagtgtagatataataaggtcaaaagacagctcatattaccctccagaatgtcattcagactcttaaagggtagacgctgatatcctacaggcaaaaaaaagccgactaatctaagccggcgtcgtacgaatcaattgtgctatgcagtaattcaaaaaaggaagcaagacaatatagaacgcaacgcccatcgcttgacgttgcattcacctgcgagagagatattgccccgaataggtagatggtttattgacttcgctcaaatttctcggcgttttttcacccaaaacggtctgaaaagcgcttttgttacaaccatttactgcgatgcaaccataaagtaacaccaccgatcaggacaactaacagaatacaaaacagagaaaagccgaaccgccatccgccgccaggaataccgcccaggttaacgccaaataaccccgtgaagaaggtgctgggcagaaaaaccatcgccataagcgacatggtataagttctgcgcgccagagactcctgcatcacctgggcaatttcatccgccatgatgccagtacgcgcgatacaagcgtcaatttcatccagcccccttcccagcctgtcggcgatatcctgcattctgcgccggtgatcgtcgctcatccacggcagccgttcactcgcaagccgggcatagacgtcgcgctgcggcgccatatagcggcgcataacaattagctgtttacgtagcaacgcgaggaaaccgcgcggtgggatttgctggtcgagaagattatcttccagatcgataattttatcgtgtagctcttcaataaattcactggcgtgatcggttaacgcatcgcatacatccactaaccagccgccgcaatctacgggcccggtgccctcctgcaaatcactgaccacatcgtccagcgccagaacctttcgctgacgggtagacacaatgaaccgctcgtccatatataaacgcattgctactaattgatccgggcgttcgtcagtactgccattaatacagcgcagcgtaatgagcgtcccttcccccatacgacttacgcgcgggcgcgagctttcaccagccagcgcatcacgcacgttattggggagtaaaggcgttgaagccaaccagcgggcgctgtccgggtgggtataattaagatgtagccaacagggatgctgactatcgatcacatcattatcttcgagcggttttactccaccacgaccatccagtagccatgcgaaaacggcatccggcacgttcacatccgatcccttaatggcttccacagcgcctccacgttacaactctcatgccgttagtctagctttcgggaaaggttaagcaatctctcattttctcattgcgcaaaaagaatgacgggaacgtgcgaaaaaagcgccttagcaacaggcgcttaccaaacatgtattatcaggcctggccgcgcctggtgatggtcgaaagaggtgatacatgagagcgcgacagcgcatgttcactgtaacccggctggcttaaacgaaatttgtcggttttagtctgtaactcgatcacctgcgcctttaaaacatccgaagaagcagatagcgcttcaaccattaagacattgctatgggttgcgctttccagatcgctcaacgccagggttatctggttaatgcctttttcctgctcccgcgtggtggtggaaatttcactcatcagcacgtttaattgcccggagccgccaacaatctcctgcatatttttttcagcctcctgcactatggcggccccctgccgcacattgtcatgcgtaacgtcgatcagcgccttgatattttttgccgcctcagcgctacgatgcgccagattacgcacttccctggccaccacggagaaaccttttccatgatcgcccgcccgcgcagcctctaccgccgcgttaagcgccagaatattagtctggaatgcgataccgtcaatcaatgaaataatctccgtcatctgcgaggcacagtcggtaatagaacgcatattttctgtaacccgcaccattaactcaccgcctttacgggcgcattgggttgcacaatccgcctgtatgctcgccattcgggtattatccgcattgtttttggtactcgccgccatttcatccatactggcggcagtttgaattaacgaggccgactgctgttccgtctttacggatagcgacagactgcgcgccgccagttgttcggaaagggtcattgccgtttgcgaagaggatctgatttcacgtaccagcgcggaaatattctccgacaggctattaatcccggggatgagtcgcccggcgcaattattgccaaattcggagatatgaatagacaagtttcctgctgcgacctcttcaatacttttcttcgcggtattaattggcactaccagatagcaggtcatataccaccaaagcagtaatgccgagatcagataaatgatattacacgtaattaaaatagggagatcgtgcagaaaggttatttgtaaagtatccactaaaagaaacgtacataccatgaatagaataatgcatgtcctgacgctgatatttctcaacatttttgacggcctacaaccaggataggagacaggttttatttttatagcatttcagatacctattgccattcgtttctttgacattctccatattcaataccagaccatcgccatttcccttagtgcaatagataaaatcatctatattcgctatgccaggatattcatccatccatattgacaagtgatgtacttatcaccattttctgcttaatagttaagtcgaaagccagtatattttaatagacgcttaaataagtgaatgactgtttctccgtgttattactgtggacagcgttatcgcccgttctcttgcagaatcctgagcgtttggatgaggcgttatatcaggcataaaatcgggttcatgcgagcttgcgctggcggtcctgtccgccagcggcaacgatttaccgactacgcttcgcatggcgctcccagttatcctgtttagcctgcaccgttttacgtaaagcgacataacatgccccgccgccgccatggtgcggcagcgccgaacaataagcctgtacatcctcaaactctgtcaaccagcgggccacatagcttcggacgatattggcatgcgacttcgcctctcgccctttaccatgaatgatcaggacattacgcaacccctctttctgcgcctccaggataaaacgaaacagcatttttcggcacgtttcgaccggttggcgtaacaaattgaggctggcctgctgagggtatttcccactgcgtaacttgtcgatgacaccctgctgcaatccttcccgacgaaattccagcggttcattcagcggcagaatatccagaaagcccgtcgtcaggaaattatcaagctgaagcgtgtcgatacgctggggcgttttaagattacgcgttggctgccagtgtacatcagtatggcgtttcagcggctggacatcctccatgacgtcaagaaacagcgctttatcgtcaaggttcatggttcatcctccagcgtttttgcgactgccgttatcataaccgtgccctgttataccgacaacggtttacagttatttccaataacagcgacaatgtcaggcaattaaccgtctcgccaggctccctttttctccgccaacgatattactgtcgctaaatgtgttatccctgactatcttttaaggagtatggttgcgggtattcctggcatgatatcttgtctcttacgttagattaagacgatgtgagagaacggatgctgagattacttgaagagaagatagccacgccattaggtccgttatgggtggtttgcgatgagcagtttcgactgcgggccattgagtgggaacagtaccgcgatcgtatggagcaactgctaaatatccactaccgtcacgaaggctatgaacgcgtttctgcgactaaccccggtggactcagcgataagcttgcagattattttgcaggcaatctcgccgtaattgataccttggaaaccgccacggggggcacaccttttcaacgggaagtatggcaggcgttgcgcgctatcccctgcgggcaagtgatgcactatggccaactggcggcgcaactgggacgaccgggcgccgcacgcgcagtgggtgctgcgaatggcgctaaccccatcagtattgttgttccctgccatcgcgtcatcgggcgtaacggcactctgaccggatacgcaggcggcgtgcagcgaaaagagtggctattacgccatgaaggctatcttttattatgaatatacaggcaaaaagtgccttatcggtcacacttttatgtaaagtagcaacaaataaattacgtattttcaaatagatataagtattcatcaaacttatacttgaattattccttctccgggatagctcagacttacgcgctcaccaaaaagatgttaaaattgacaaatatcaattacggcttgagcagacctatgatcccggaaaagcgaattatacggcgcattcagtctggcggttgtgctatccattgccaggattgcagtatcagccagctttgcatcccgttcacacttaacgagcatgagcttgatcagcttgataatatcatcgagcgcaaaaagcccattcagaaagggcaaactctgtttaaagcaggtgatgaactgaaatcgctctatgctatccgctccggaacgattaagagctacaccattaccgagcaaggcgatgagcagattactggattccatttagcaggcgacctggtgggttttgacgccattggcagcggtcatcatccgagctttgcacaggcgctggaaacctcaatggtatgtaaaatcccctttgagacactggatgacctgtccggcaaaatgcctaacctgcgtcagcaaatgatgcgtctgatgagcggtgaaattaaaggcgatcaggatatgatcctgttattgtcgaagaaaaacgccgaagaacgtctggctgcgtttatttacaacctgtcccgccgctttgcgcagcgtggtttttcaccgcgtgaattccgcctgacgatgacccgtggcgatatcggcaactatcttggcttaacggtcgaaaccattagccgtctgctggggcgtttccagaaaagcggtatgctggcggtgaaaggtaagtatattactattgaaaacagcgatgcgctggcggccctcgccggtcatacccgcaacgtcgcttaaacgtcagctaaaccattgatgttatcttctgccatatcgttaaatttttctcatttattgatctggcagaagcgcttcccctgtttcattcaccatatttgagttactctttagttacaaactgcgatgacagttgtaaggagaccctgtatggctatgtatcaaaatatgctggtggtcatcgatcccaatcaggacgaccaacccgcattacggcgagcagtttatttgcatcaacggattggcggcaaaattaaagctttcctgcctatttacgatttctcgtatgagatgaccaccctgctttctcctgacgaacgcaccgcaatgcgtcagggcgtaataagtcaacgcacagcctggatacgtgagcaggcgaaatattatcttgaagccggtgtccccattgaaataaaagtggtctggcacaatcgtccctttgaggtcatcatccaggaggttatcgccggcagtcacgatctggtgttgaaaatggcgcatcagcacgatcgactggaagcggtcatttttacccctaccgactggcatttgctgcgtaaatgcccaagccccgtgtggatggtcaaagatcagccgtggccagagggcggcaaagccctggtcgccgtgaacctggcaagcgaagagccctatcacaatgctctcaacgaaaagctggtaaaagagaccttacaattggcggagcaggttaatcataccgaagtacacctggtcggcgcctaccccgttacgccaatcaatatcgccattgaactgccggaatttgatcccagcgtgtataacgacgccatcagaggccagcatttactggcgatgaaagcgctgcgccagaaattcagcatcgatgaaaaagttacgcatgtagaaaaaggcttgccggaagaagttatcccggatcttgccgaacatctccaggcggggatcgttgtgcttggcaccgttggacgtaccggactctcggccgcgtttttggggaacacggccgaacaggtcattgaccatctgcgctgcgacctgttagtcattaagcctgatgagtatcaaacaccggttgaactggacgacgaggacgattaatccctcttccgtcctgccggatggcgctgccatccggccaacacctcattcctgttactcatctccgccgaggaaatagatccccaaaggaatcgccagcagaatagtgaacaccagactgtaaacgaaaatcattgccgactgaatggcatacatagagcttgtccactcggacagtggaatatgatattgctcaatcacaccgccgatagtcgcgcgcgttaccaccgatgccgcaacgataaacactgccagcaggcataacagaaattttttccccttcgccgatttcagcttcatcatgatcatagtattgtcctttacagatgactttgttacctgatagcaacaataccatgacaatcacgcgatgtctgctccataaaacgtaacattgtatttacataaaaagtaaaccgctgagattaaagctgatagcactatttcttctttttacttatcgatgatctacgcgtttatcctgggtaaaatacctgttaatcaggtcattctgagctgttatcgtaggaaggagcggaaaacaataatgttcactgaattttttctcaaaaacgcatttaatctggcgatacttttcagttgcggtatggcgttgctggtcgtgagattttggctcagccgtaacgtacagtggaagaaaggattcacgttccatgcggcacagttttttatttacgcgattattattggaaccatcgggagcatcctgaataatgctattgaagattataatttgcgttttatctcttccggggtcattgattttatctgcacctcgctcattgcgcttattctgacgataaaacttttcctgattattaaccaatttgaaaaagcacaggtcaataaaggtagagatgtcaccagtacccgtattctggcacgggtcataaaaataaccattattgtcgcgattgtcttactgtatggcgaacattttggcatgagtctgtccggtctgctgacctttggcggtatcggcggtatcgctgttggtatggcgggcaaagatgtcctgagcaattttttctccggtattatgctctatttcgatcgccccttcagtatcggagactggattcgttctcctgacagaaatatcgaaggtacggtcgccgaaatcggctggcgaattacacgaattaacacattcgaccaccgcccgttgtacgtgcctaattccgtcttttcatccattagcgttgagaatccgggacggatgaccaaccgtcgaataaaaacggttattggattacgttacgaagatgccgacaaaattggcctcattgttgacgctatcagaaacatgctgcaggcgcacagcgatatcgatcagaaacagacgctgttggtctattttaatgaattcgccgactcttcgctgaatattatggtgtattgctttaccaaaacaacaatatggcaggaatggcttgctgtacagcaggatgtttacctgaaaattattgcgattgtccaggaaaacggcgctgacttcgccttcccaagccagacgctatatatcgatgacccggaggccgcgcctgcgataaaataaaagatagccggtgcccgataacgcttatcgggcaccgaggcttccctgtccggatgacgggttgttagcgccttccttacggtgatcaacggctcttttcattcaccgtcatggtaaattcaagcacctcattagtgtcgttaacgtaggcatgaggcatatcggttctggctacagcggagcagccctcccgaataataaagcgtctaccgtcgactgttaatgtcagtgttccctgattaacaaacagtaattcacaggtgtctgccggatgccctgccgactcaaactgttcaccaggatgcattatccattgccatagttccagcatatccggcccgctggttcccgccattagttttgcactgccgcctttctcgccgcgccacaacaccggaatagcatcccggttgataagatgaaccatcggctcgctggcgacgttgacaaaatccgccacggacactcccattgccgccgcgatcttacataacagcgcaatgcttggattagctttacagccttcaatttccaccagcattcctttactgacgccggaacgccgcgcaagctcatccagcgacatctttttttggctacgaaattgtttgatacgttgggaaacagcttcatttattgtgctgacgtcggcgcccgccgtggtcgataagttgacttttttggtcattggtcgatatcatagaataaaatagtcattacaggattatgcgatgtcttctatgttaccgtcaatcagcccggaactggcccgtatcgctcccggctttcgtgcattaagtattaatgttattgccgctccggttcgcgatgcgcaggtcggagaaatcgcgttaaaagaggcctgtcaggccgtaattaacggacaaccggcgtgggcacaggcgcatatagacgcctggaatgcggtgtttaaagcattcggcgcaaaaccaaagcgcaccccctgctcggctgaagcgctacgaaaacgcgtgttgaaggatggaacaatggcggcgctggacccggtcgttgatctttataacgcggtgagcctgcgctatgccgtgccggtaggcggcgaaaatagcgcggcttattgtggatcgccgcggctggttttcgcagacggtagtgaaacatttgataccctgaaagaaggaaaacccgttaccgagtcgccagaaccaggcgaagttatctggcgcgatgacagaggcgtcacctgtcggcgctggaactggcgtcagggagtacgtacccgactaagcgcttcagataaaatgatgtggtttatccttgaaagcttgccggaaatgccggttgatgaattgtacgcggcagaaaacatgctgactgacggccttgaaaaaatgatgccaggtttacgttttgaatccacgttgataggtgtttgattgatattgcgtaacaggagaaataccatgtcgctgtttctgacaagttttattttcgaaaaaaaagagtacgacgaagagttttatcaactggatggctggattgagcgctatacacagactattgatggctatattgggatggaaagctataccgatgccgccagcggaagaatggttaataattattactggcagacccgcgaatcaatggagctattgataaataatttacagcaccagcaggccaaatcacaaagtcataagtggctttccggttaccagacgattattgcagaaattcaggggtgccataacgttaacctgccccatccgctggcatcattttcagttccctatgcgtgatgcaatagtatatgtattaaatgtgggggcacacaggagaatgcctgcgcccctgcattgccagttattcggttttctgtgcaggggcggcgctgatataagtgattaatagacaggaagatgagtgatatctcgtggtacactaacatgcgtaaccacattgttttcatcgcactcaatcaacgctctggcaaaaatactgagctcattaattttcagcccggaattatccaaaaactggcggcaagcgtagtcagaaacaaaaattatgccgggatgaatatcatgttcccgaataaaacgggcctgagcaaatggcgtatccatactcaacacatatactgcccggtttgagtggctacccgctgatttaaggcggtcactatattcttttacctgccattcacaaaccggcgtatccagtgacgggacgacaataatccgcttttttatccccgggatacagtaacccggtaataaattatggctcaccagcccctttgtgcagggtaatggttcgccttcagccagtataccgggtttgagggtcagttgcgttttgccaaaggtcacagcgtgttcctgacccaatgagatataatcttgtgttgttgttggcgtcataaaaacttctccttttaacatttgtattattttagccataataattatttagcaatccgctaaaaaaccaggtgaacatccataataagatgatggtgataaaaagaattatattagccataatgattaatatagttttatagtcttcctctgatggaaatttctttcctgaacaaatcccctgcatattcaaaagatatgtcaatacgttcgttactatgtccacgataggttataacttgtgtatatttacctggcacattttctttcttaatagggccataatcccataagccttttgaattttcatactttacagtcttatcaatgagaacttcatttacaggatttccgtcgatatccttaacaatagttgtgatggtggcactttcacccggcgataatacaggtttatctatactcataactgttaaatctgggcttggcgtattagatatagtttctgtttcaatatactgaaattcagataccgatggcacaggcgtgtaccctgacgctgaagccatatccgtttcattataaatttctagtttaatctttgaaccccgatgttccttttggatattaaatttatgctcacatggcttttcacgtttaagtatatgctgagaattatctttattgatctgataatacgtacatactgtagtaaacgtttccgcagactgatagttattatccggatcgctgatgcctagatatctatcatccctcgcaatagtcattcccggaaaaggtgtatacttttcaatagaaaagtcaagtccattaaacttcaattcgtaggtatcacgaggtgttcctggtctgtgcccaacgctcggcgccgtaggaggagaaaacatcccgacggttgccgcggaagttgtcgacgaatccgccaagacgcttatcggcacagccgccagaagcaggctatagataataagattatgtttcgacatacgcactgttgatcctttttaaaacattaattcgcatcagaggttgcggtattacccttagcatttcccttatcagaaataattctgacgcggatatatttattctgaagcgattccccattaagactataaggaagaagccaggtggcctttgtcgcccccggtacggattgccaggatttcatttcatccgagatttcccactgataattaaacgcatcagtacagtccgtgttatttacacaaagcgttctggctcgcatttctgttccgacgactggcgcagtaacgcttccgttggcttcttcagtaccctgcgtaaaaagcacctccacagaagtgaccttctgcgcaatactgtctgactgcgcttgtagtagtacggtacccttcaccggatgtttatcgtctggtccgcttgcttcaatatgtaatttgagcgagcgggcatcatcgccgatatgggtcaccagaacccgttcaacccaatggccgtcacgctctgtaccaccgagcgctttaaatgccagacccggcgtatctgattgatacttaatatgacgtggtttgagcgacgcccactcctcttcagaacgctcgcgcacgtagtgccactcaataaccttcccctcttctccggcaggaagcggcgtactgataacaaagttgccgtcctcaacctgaacatcgtcattgataacatttatccaggaacggaaactggtctcatcctgtgtcacccttaccgggatacgctcggaggtcacgcgagtaccccggctgtcagtcaccgttaaataaaggctatactcctgaccgtcggtcgccgtcagcggaagttgaggaaggataaggccgctgcccaaactcccctgaagctgaagtccggcgagaagttccgcatcacccgaccactcaactttctcaatcgggtaacggctatctaccgtcgccattaatatcaccagcgtcccggacaggcctgacaccggcattgccataatgcggattttactggcctgctcccgatacgccatgacgatatcgtaattacgatcgacaaaggcacgccgattagtcgtattcgacggcgccccaacgttgcggtaatcaagctgttcatgtaacggcgtaccgaaggaatagttgactctcagaccgccctctgcctgcgatccgccgttaccggcgtcccgatatcctgctctgacctcaagcaaggggacaggattccagaccagagccgcacctgcggcgcggggattccggcttaatgtaccgttacccaatagatcaactttatccccgtaatactgttcatatgtcagctcgccactgaaccagggaaaatcgggaagcgtgccttttgttcgcagatcaaagccatatgccggacgctcatcatgtaattcatgaactactgacgttttccagccggtgagagggaaataatagttgccggaaaaggccagactgtctttatagacttccccgccaatgccgccacgcaagtgggaataacggatgtcggcatccagaaacgtattgacgccgagcagccatccattgacctcctggcgataacccacaccaacgttaacataggtgcggccatcgaaactgctgctgtcgtggtcgcgaaagccaagctggccaaagagtaaagacgatgttgtttcctggacgggaataaacatatcgaactctgatgagcgatatttcgcgccatcttcaagattgacgccaccacggaaaataatctccggaaaagcgctcttcatcccctcgttcaccagatgattagcggcttgccctggtaatgcctttatttttcctttggcataatcctccagcgtcccctcctgcagatgcggagaaatagacgatgccgtccctgcaatccatgactgaatttcattatcgctatcagcgatgaccggcagtggaatctgactggtaacaatggcccaggttatatatttagtaatgggttttttagaaaaaaccactttattgtctcctgctatatccccctgcctggcagagggagtatttaaataagatgtttatttggcgataaccatcagcgacggatagcgcgtttattctccggcgtggctttcgtcgttttaggcgtaacgtggacacggaacagtttattctgctcagttcccttaataatatatttatgcttttcagcgttggtattattcagatcggtgaacctatctggtgtcccggcatccgccatctgccaggtaaagttataattactgacctcacactcagccgccgctgtggcggcacattccagtaccacttcaagggtgccgcctaccactggagtgttggcgtcattggtaccgttgagttcatcagtcggtttaccactttcattcaccacattgatagtgacagaacgtagcttattagaaattgtaccgtctgcggcggagtcgccgctcaccccagaagatgcagaagttaataagacagtggcaggcaagaatgcactatccggcgtccccgttgccgtcttaatccggtaaacgattttaatttttttaccgcctgcataagcaggaatggtaaaagccgtcccggttgccgccggggttccagaaggatcggcggcctcattatccaccagataccatttaatatcgtcggcattattcattttatccagcgataagggatccccatcctcatcctcaataaaaacatccgctatctggagggttgaaccggtcgtcagttccccagacacttctatcttttttgcattagtagttgccacaggacggtgaccaacagaagcaggcgtagcagaagaagccatatcattggctctgatattcgccaccgcctctactgagaccacggatgcacaaatcgctaaagctaataaagattttttgaagtacaaaacaattcatcccttttattaaatcattagaaataattatgagatttataatctcacgggctaaaaattcaggattattcaatcattttaaccgtctgtgaaattatgcccttcgccatgccaattacttagctttactggcaaaagccgatctccaagtgtaaagtttattcagaaacgtcaagcaatttaaatctttcttgttttgccagaaaagctaacaaccccccactggtttaataacaccgtatgtcaaacaccttaaatgtttatattttcggcttcaataaagaggaatgatgatgaaaagagccataatagtctcagtattagagcaaatagaaaaaaatcttgaagagaggattgatattgaaaagttggttgttataacaggttattcgcgaaggagtttgcaggatttttttaaagaaaagtgtggcgtctctatcggaaaatatatcagacaacgcaagttgagcagaagcgccactctgctaaagctgacctctcagtcggtcacagatatcgcgttcagaatggggtttgattcagtgcagtcctatagtcgagagttcaaaaaaacatttggcgtcaatcccaataactatcgcaaggctgatttctgggatctcagaaacctacggcctccctactggcttgactgtgatgggcattatcagttcgaaatttgtcagcttacgtcaaaagaaattttcggatttcaaacatctcatcagatcgcaacaaatgaccttcctaaaaaagcgtcgcctataaaatggaaaatcattcatgagacgctcaggacgtggggcgaaaatgtgtattgtctctcgtcttttaagccggataataccaaagaccaggtcatcgccgtaagcagtttttttggtatggaacataattccgtcgatggaggaaaaatacccatgtcgagggtaataaaatgtggtaaatatgcaaaattccatttcgttggtcataaggaacaatatcaacaattttccaatacaatatatatgtgtatattgccaaaactgaatattatcagaagagaaggagaagatattgaatacttccatttggcatccgtccaaaagcaacagaataatgaatccattgtcgatctttattattacatccctgtactgtaatgacttcgtactatccacgcatttcatctgaaaagtcttctcttttcagaacggtaataaaactctcagtattgattctggtaaaataagtgactattaatataattaacgttttgaaagaattaaaaaaaataaattgcgtgcacgcgacaccggggacagatttctgacagtactgtacggtgtagtgatcaggtaatattggctacagtttacggtaaaagcaaagtccatactttaactattaatgggagtatgctggccgggcggcttgcggggccttcatgctcccacatttacaatgttggtatgattacattctctctatactttactgtgctaaccttttatctcgttgagataccgtttaatttaaatgttctctttttgatgtacattataagaggagacattattcatattttcgaaatcagggcagacgatatgtatacaaccatcagaaacacaacgctagcaatggtagcttgtttttcgtatatcgcacatgccagtacccaccctcctcttattatcaccaggggagccggaggagacgcctccggagccgcagtcattcatgataattggcggcatggcactcctgacctggtcaatcttaccgatatccccatagataaaatcagaccagaaaaataccgttgtgtactgattattgggcaaggagctataaaagagatgcttcttgcgaacaatgcctcagcaatactttccggaaaaactgttggtctttatactcatctgatcgatcagaacacgctcagattacttcggcaattgcagaacaaagtgagattcaatctcttttttacccgctcgcagataactctactaaaactaaggaacatttcagaatataattttttgagttctaaagtaaataatgtctggggacaagactcactagcaattgaaacagtggcacctgacaggggtaatataccggaaaaagcgcttcccctcaaaacaacggattatgtgatctggctgggtggaaactatactacctcttctggtacgcagcgtatcttcacaaacgatcagattgttgtagccctgaaaccactacataatgttatttcaccaaatgcatcgattgctattatgctttcaccacgtttttttgataatagcatgagtaaagaagcaaaagttaaacgactgaaggcagtgcttaacaccttttcgcaaaatagggtcacattttatatgagtaaggagatgcttgctaatctgaaagaatttgatttgcctgttcaactatccccttcttacgcagagctgatgcgaatgccctgggccagcgctacccggcattttgcctctgtggatcaatataacctgtttgctgatctcatacctaaagtcacgccgtttcttcttgaaccgaatgatgccgatcaagctctctatgcgacggattatcttaatacccggcgtgtaagtctgacccaaaatattcttaaccatggttgtgactaaataaaacgcgcagaatccgggatagttagcaatccaaaacagaccgttagccatgagtactgtttatcttcactatacagggaacaaccaaataactgacaacacaaatcaagccgagacccggaattcggctatacaggcgctctattcaattcaggcccagaaacagtccggtacccatactggacacggcctcccaactgctttagcgcattaccagtccagcttcgatgcgccttctgtcgtctgcactatttcactggttttaataacgcgatgataaccataaacatcagcgtatttcgtcattccggttgcggtgtcaacctccggcttaccctgcgtttcaataatctctcccgtccgggtcgtcatggtataggtcgttgtacatccggctagcatcaacactgataagctaagtaccgtaataagactacacttttgcatttcttgtttccctgacacctctatttttgatgtactttaccgaataccgcaacggcaagatggatgattagggctattgctccctgtttgtccgtatctgactggctcaggttttttgatgcgctgcgttaatccggcagtaatcgctccagcacatccccagccagaagcacgctctcctgaagacgctccaggctataccccgctcgcgccttggcggaaagtcccgccattagcgtccccataaagtccgtcgtccggtcagcctcttgcggataccgcatggcgacataagtgcgaatcaggttttcagcagcgatgtaaaactcgcaggcggcctctcgtgccggtttatcgttacaatgagcgccctccagaaccagacatccggtggcatcaggatcggcagcgtaacgtcttgccgcttccatcagcacatcgataagacacttcgcggtcgggcgatcgtgacgcagaagcgccccgagcggaatcgcgtcggtcatcctgtaacgctttaatacgcgagtatacagccccagcttgctgccaaacgccgcatagaaactgggaggattgatcccgaacgcttttgtcagatccgctacgctcaccgcgtcgtatccgcgcgaatgaaataagtgttgagcggtttcaatggattgctccggatcgaactggcgagggcgacccggcgttcggctatgttttgtagtcattactacataactccttgacggcatgatttcattacgcatattgtagtgactactacaatatcataaaggacatcctgatgatgctatttcgcaacaaatctgtactggttttagggggaagtcgtggtatcggcgcggctattgtacgacgctttagcgctgacggcgcatcggtcgttttcagctacgccggatcgcgtgaagccgccgaaaaactggcagcggaaaccggaagcaccgccatccagacggatagcgccgatcgggatgccgtcatcagcctcgtgcgtgagtacggaccactggatattctggtcgtcaatgcgggcgtggctctcttcggcgatgcgctggaacaagatagcgatgcgatagatcgtttgttccgtattaatatccatgcgccttaccatgcgtcagtcgaagcagcccgcaacatgccggaaggtggacgcattattattatcggttccgtgaatggcgatcggatgcccataccgggaatggccgcgtacgctgccagtaaatcagccctgcaagggctggcgcgcggcctggcccgtgattttggcccccgcgggattacgataaatgtggtgcagccaggccccattgataccgacatcaatccggaagatggccccatgaaagagctgatgcacagtttcatggcaatcaaacgacacggaagacctgaagaagtggctggaatggtggcatggcttgccggtccggaagcttctttcgtcaccggcgcgatgcacaccatcgatggtgccttcggcgcctgacggccaggcgaatatcacacggttgccgtctacgctccggcaaccgtgttagaagctgttcatgcgagaaaacatccgcaagcgccgggatcaatcgtggattttaacgccaagacaaccgcgaacaaattcaggattaaaatgcttcaccgcttcgccaacgtagcctaaatcaagggcgttgatttgagccatttcgttatccgttagtgagaaatcccagatggcaaagttctcttcaatacgttcctgtcgagtggatttaggaataaccgtgacgccacgctgcacgttccaacgcaggacaacctgcgcgatggttttttgatgggcatcggcaatcctttgaagcatgacattttcatacggtttatgtctcccgccgcctaacggtgcccacgcttcaggctgaacgttataatgcttcatggtttccagcgcggcgggttgtgcaaagtatggatgcaattcgacctggtttaccattggcgtaattctgacggtttcacagaagttggctaacacatgcgcatagaagttggacacgccaatggcttttagtttaccggcttcataagcgtcttccagcgcgcgccacgcgctaaaataatcgcccattgcctgatgcaataaatagagatcaaaataatctaacccggattttttcagcgacgcttcaatacctgctttggccagatcgtagttagccatatcttgcacccacagtttagaagtaataaataactcctcacgggtacacagacctgtcgcgatggcttcacgaacagcgtcaccaacggcatcttcattgccgtataccgcagcggtatcgataagacgataaccgctgcgaatagcgcttaacactgactgctgacattcttctttgtcggttaccttaaaaacgccaaaacccaccataggcattttaaggttgttacttaatattgaatattccacgctaaagcaccctttcgtcgtaaagacgccatgataagagcaaaatacaggtacaatgagtattgttaaatccgattatatttatacaaaaagttcattaataacagttgtacagattttttattgcatccaaacgttcagtgcttgctatatcctcgccgtgtagcacctgtttgataatgccttttacttatgcgtcaaaaaccagtaccgtcattttgaccgtctgtgaaaaagttttctgaacaggcaatgcgatatccggaataatattttttagcgaagaggctccggctggctcagcgccgttttgcaccagtcataaaaagcgcgtaccgcaggcgacagaaacctgttttgcggatagaccagcgcaagcggcaaatcataaaaatggttgtccatgcaggtcaccagcgccccgctgtgcagatacggcgcaaccagatagctggcgacgcgaattaaccccagcccctgtattccggcctgaatataagcgtccgtatcatcgacaaccagcgtctcctgcacccgcatcgcgtaatcctccccctcacgcgtaaaaaaccagtcggtggtacgcccggtgcggtggttcaggtagccgactgcatggtgtttttgcagatcatctaaattttcagggctaccgtaacgctcaatgtaagtgggcgatgctgctatcacccagttaaagctggcaagtggacgggcaaccagcgtggtggaatcatcgattctgccggcccgaatcacgcagtcatacccttgaaggataatatcctccacgctatcgctggaacaaagtatcagctccagctccggatactggcacaaaaaggccgggagcgtaggaataatgcaatgccgggcgagagattgcggcatccccactttaaaacgccctttgggttgtgccgcccggccaggaaatgacgactccatggccgcgatatctgccagcactcttttgcactcttcgtagtaacgccgcccctctgcggtcacgctaagtttgcgggttgtacgttgcaaaagttgaatcttaagccaggattccagttctttaaccactcgcgataccgttgagcgcggcacgccaagcacttcggcggctctgataaaactatgggtatccactacgcaaacatagacctgcatcgcttccagcttgtccattttccccccgccaattatcccatttatcagaacagtctaacccgtcttcggcgtcttatcgaacgcagatccctgacgtaatctctatctacaggtgaatcaacacagagaggcgcaaatgaaacaatccaataatcaggtgggtgaaaaagtattggtgctgggcgcgggacaactgggggcgtcagtgctggcgtcgttggttccggcgatcacacagcgtaatggttccgtttgcgttattgtgtcagggcgatccagggataaacagagcaaacgacgttccagcattcatcaacaactggcggatgccggtgcgcggtttatcccggtcgacatcgcagacagttcggttgcagcgttaaaagatcaattccacggttttgatacgatcatcaattgtatggggtttgtcgccggtgcgggtacccagataaaaatcacccgcgcggtactggaggcgggcgttaagcgctatttcccctggcagtttggcgtgaattacgatgtggtcggcaaaggcagcggccagccggtgtgggacgaacagtatgacgtcaggacgcttttgcgcgagcaaaacgtcacagagtgggtgattgtttcaaccggtttatttacctcttttctcttcgaaccggcctttgatgtggtcaacttagaccaaaaaaccatcaatgccctcggcggatgggaaaggcaggtcaccgtcacgtcgcctgcggatattggtcgcctgaccactgaaatttatctgcatcagccgcgtatcactaacgaagtcgtctttgttgcgggggaaacgacctcttatgcaaaactggcgaaaacggtcgaacgcgtgacgcagcaaacctttacccgaggtgtattgacgctacctgacttacaggagcaactccgtttacatccgcatgacccaatgctgcgctatcgcgtcgccttcgcgcgtggtgacggtatgtggtggccgatgagtgacacctggaatgcacaacatcatctgccgacacaggatattgccacctggctgaaaacacagcaatgagaacggcggcatcaggcgctcgcttaatccccatgccttctgccagcatcaggcggcgggcgtggctaccttgagttaacaagaaaccagtacgcatcagtgcttcacgatatacattgtacggctataggccacatcttccgggttagtaatggggtatccctttacccacggtttaattaaccggccattggtatactgataaataggtgctataggcgcttgttccgttaaaattttctccgctgcattgtaatccgcgttacgcgcttcggcggtattttccatcgtcgcttgcgtcaggattttgtcataagtcggattagtaaagcgtgaaatattccccgtatgcgtggacgttaataaggataagaaagtcgacggttcgttgtaatcacccacccaggagacgcgaataacatcaaaattactggtattccggctgtcgatatacgttttccactcctggttttgcaatttcacatccacccccagatttttcttccacattgacgccaccgcaatcgcgattttctgatggttttctgaggtattgtaaagcagagttaatttaagcggcttctgcgatccgtagcctgctgcacgcagcaatgttttcgcctgggcgttaagttcttcctgactcatttgttcaaacggtgaaggatcgggcttaaatcctgccgtgacatccggtgtaaaatgccaggccggtttttcaccggtacctaagactttttccgccatcaaacggcgatcaatggtcatacttagcgccagacgaacgcgggaatccgccgtcggccctttctgcgtattaaacgcataataataagtccctaattgcggcggcgtataaacttgccctggaatatccttcaataatttctggtacatatttttagggaaagattcggtgatatcaatatcaccggcaagatagcgtttcgtcgcagccgactcctggttaatgggtaaaaatgtcactttttgcagtaccgttttcgcgttatcccagtaatgcgtattaggcacgaccaccagtttttcatttaccacgcgctctttaagcacatacgcgccattgccaatcagttttcccggcttcatccagtctttgccgctttcgacattcgctttttggaccggataaaaggcaaaactggcggtcagactggcaaaccagggcaacggcttgtcaagctgaacacgcaaagtgtgcgcgtccacggcactgacgccaagctgatccggcgtgactttactgtcgataatggcttgcgcattagtgatgccagccagagcggcaaaccaggcgaagggggaaagcgttttgggatcaacgaggcgttgccagctatagacaaaatcctgggcggtcaccggcgttccatcggcccattgcgcatcatcccgcaacgtaaacgtccagatacgattatcattgctcttccactggctggcgacgccagggataatttcacccttttcgttctggttaaccagcccttcaaacagatcgcggatcacctgaatttcaggcagcccaacggctttcgctggatctaacgaagcgggctcatctttgatatgacgcaccagttcttgtttctctgccagtaccgttccgccgggaacatccgcagcatatgccagggaaaagctgctaaccaacagcgcacaacaggttactgaaacagaatgcctcatagaagttcctcaaagatgagttaaatgacaacgtaattatttgtttcagcagaaagaaatgcaattatcttccgccagaaagttgatatcgcgccatacaagagggtaaatagaaaccatttgataatcggcgggttttacacaacactacgatgattaccctactggtctcagcttcgggaaacgcgtatgactgtcacccgcccccgtgccgagcgcggcgcatttccgccaggcactgaacattatggacgttcgctactaggcgcgccgctaatctggtttccggcgcctgccgtcaatcgcgaaagcggcctgatactggctggcacccacggggatgaaacctcatccgtggtgacgctctcctgtgcgttacgcaccttaaatccgtcccttcgccgtcatcatgtcgtacttgccgttaatcctgatggctgtcaactggggttaagggcaaatgcgaatggcattgatctaaaccgtaactttcccgccgccaactggaaagcgggtgagacagtttatcgctggaatagccgcgcgcaagagcgtgatgtcgtgctgctaaccggcgaccatcccggctcagaaccggaaacccaggcgctttgccagttaattcatcgactccaacccgcctgggtcgtctcttttcacgatccgctagcctgcattgaagatccacgtcgcagcgagctaggcgagtggctggccgatgcgtttgcgttgccgctggtgaccagcgtaggttacgaaacgcccggttcgtttggcagctggtgcgccgacctcaacctgcactgcattaccgccgagtttccccctgtttccgccgatgaagccagcgaaaaatacttgctggcgatgtcgaatctgctccgctggcatcctaaagatggagttgacccgtcgtaaagcgtagcgcaggctcaacatcaaccgccagccatgttgggccatcaagatcggcgaagctcacctgcggcataagcggcagcgcggcgctaatcgctcttgatgtacagagcatacagcccagcatcaggccgaatccttgctcccgcgcctccgttgccagcgccagcgcctcagtcagaccgccggttttatccagcttaatgttgatcatatcgtagcgccccgtcagggctttcagactactgcgagtatggcagctctcatctgcacagatgggcaacggatgaataaaattttccagggcggcgtcatcctgcgcgggcagcggttgctccagcatcgcgacattcagatccgccagtaactggcaacgcgccgccagcccttctgggcgccacgattcattggcgtccacaatgagcgtcgcctccggcaccgccgagcggatcgccaccatacgttcgctaatcagacgagcatcgagtttaattttcagcaacgtcgccccttttttccatagtgccgccgcactggcagccatctgttccggcgtgcctatcactaccgtttgcgcggtagtaaaaaccggggacggcgtcacgccgagcagcccggcaaggctttgctgccgctggcgggcctgcaaatcccataaggcgctatccaccgcgttgcgcgccgcgcctgccggcaacagtttctgcaatgcttcgcgagtcagcccgttttccaactgaggcacaatactcatgatttgcgccatgaccgaggcatcactttcaccataacgtggatatggcgtacattccccgatgccttttacgccctcttcttccagttcgacaacgacaacatgcgcttcgcttcggctaccacgcgcaataacaaaaggcgtatgtaacggccaggtttcctcatataccttaacagatctcatctcttcccctctgatagcgccggacgcggcttgctacaaatagtatttgccgtgttaatgaataatgacttaaactggatttcgacgttaactataagtaaataggaacataattatgtcacagactgtacatttccaggataacccggtcaccgttgccaacgttattccgcaggctggtagcaaagcacaggcttttactcttgtcgcaaaagatttgtctgacgtttccctcagccaatatgcaggcaaacgcaaagtgctgaatattttcccaagcattgatactggcgtatgcgccgcatcagttcgtaagtttaatcaactggccacagaagtggagaataccgtcgtattgtgcgtttctgctgacctgccttttgcacagtcgcgtttttgcggcgcggaaggcctgagcaacgttattacgctttccactctgcgtaataacgagtttctaaaaaactacggcgtcgaaatcgttgacggcccgctgaaaggtttggcggcgcgcgcagtcatcgtgcttgacgaaaacgacaacgttattttcagccagttggtggatgaaatcacccacgagccggattacgacgccgcgcttaatgtcctgaaggcataagccagcgcctgctggcgctacgtttgtcagtgctacaggcggtgctcttttgtcacaagaaggcctctatccggaggccttcttttttttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcctgtttacgggccgtaagtaacgaagtttgatgcaaatgtcagatcgtatgcgcctgttagggcgcggctggtaagagagccttacaggcgcatcagaaaaacctccggctatgccggaggatatttatttttctactcttcacccttcttctggctcagaccatattcacgcagcttattggcaatcgcggtatgcgatacccccaaccgtttcgccagtttacgcgtactcggatagctacgataaagctgagtaaggacagaacgttcgaaacgactggtaatgtcatccagcgaaccttccatcgcatcctcgccgactgccaccgtcgcggcatcgtagtcaggcaacaggatgtcctgcggacgcagctcatacccttccagttgcgtcagcgcccgataaatcgcatttttaagctggcgaacgttacccggccagccgtaacgagtgaggaccgtactcagatcggcagacagtttcggtcgtggaacgccctgttcgtcggcaaaacgcgccacgaacagttcggtcaacggcataatatcctgcggacaatcgcgcaacggcggcaaattaagcgtcagaacgttaagtcgataatagagatcttcgcggaacagtcctttttgcaccagctccaccagatttttctgcgtggcgcagataacgcggacatcaacatgaatttcgtgatcttcgccgacacgacggaacgtaccatcattgagaaaacgcagcagcttcgcctgcatacgcggtgacatttcgccaatttcatccagcagcaccgagccgccattcgcctgttcaaaaaagccttttttaccttccggcgcatggccaaatagttcgctttctaccgcatcttccgggattgaagcgcagttgagcgccagatacggtttcgctgaacgagggcttgcctgatgacaggcataggcgaaaagatctttgccggttcccgtatcgccggtaatcagcagcggcgcgctgagcatcgccagtttgcgcgcctgctcaacgacgtgcttcatctttgcgctcacggcaataatctgactaaacgcgctcagatcctgcgtggacaaattctgtagctgctgtcccatacgaatcgtggaacgcaacatcacgaccgccccggtcaacacgtattcgtcattttcgttttgtaaatgtaccggcgtaatctccatcaggaagttttgcccgttgatcacgacatgttcgttatgggagctttgcgggttaccgtccagccagcgctgaaaattgaagccgttgattaattgtgcggcggtatggtgccgcattcgctcctggctctgggcaaaaagttgacaactcgccgggttcgccatctccactttactcttcatatccaatgagagcaccggctccggcaacgcctcaagcagcgcgctcagggccagatgttcacgttcggacggcatccagggaacggtacggacatccgttacgccggaaatacggcggatttcggccatcaggctgctgaagtcggtgaattccagctcagcaaaattaagataaattcgcccaatgggatcaatctcgattccgcgtaaatcaatgctacgtaacaccagtaaatcaagtaattcgcgggtcagaccaagtcggtcttcacaaaagacttccagacgcatgggaaccttcacctgaataatgaaccattaaatagatgataagccactattcggctggcaggaaggattctgtcaacaaatattgacagcatggcggaaaaacgggcgctgcggcgtaaagccaggcaatcagcgccctgtggaaggtcatttctcaggcgacgacttactcttttgcagcgtctcttttagctgaccgataagctgacgacgaaaatcaccgagacgtggtttatcgttatcggcccacggcaatggtcgacatagctccatcgcttttattcccagtcgagcggtaaggaggcctgcgccaatcccctgcgccgcgcgcgtagacaggcgtgcggccagatcctgagacatccagtccataccgacttcacgcaccagctcactggcccccgcaaacgcgatattcagcaacaccagacggaacagacgaaggcggctgtaataaccaagttcaatgccatacagcgttgcgatgcggttaatcaggcgtaaattacgccaggcaataaacgccatatccaccaacgctaacggactgacagcgatcatcagagtcgattccgcggcgaaacggctaatctcacgtcgcgcctgcgcgtcaagtaccggctgtaccagatgcgcatacaagccgacgatttccctgtcgttttgcgtttcgtgaatagcggcataccaacgttgtaatgccggatgtgattgatcaatccccgcctgctgcgccagtttttcgcaaaatgcgcgacctttcacgacgctatggctatgtaacagttcacgcgcctcatcgcgctcatgcgcccgctggcgcaagcgccataatcgccaccactccgtgaccaccgatcccacgccagcgccaacgatcagcgcgcctgcggcacagccgcctaaagcgacccagtcctgagtttgccaggcattcattgtccactgtacgccttgcccgaccacgctcgcgccaaacagcgccagccctcccatcaccattttacgccacaggctgcgtttggggcgcagcgcggcatcgaccgccgcttctgccacgccttcgtcttccgggcgctcatcgatagccgcaggcgcaaatgtatgcgactccgcttcgctgaaagtttgctgcgctttgaaggccgatgtaggttcctcctttagcggttctgcaaaatcaatacgcggttttaacggttcgctcatcgcagcttatctcctattaaaaactccagcgcagcgtccagacgaatgtgtggtaatggtttatcaacatccattacctgcggacgaaaggcttcgaactgaaagccctgcttatcccaaaacgcttgtcccggcaaacgcgaaggcacttcgccggggtacacggttaacggcgcgccgtcactcaaacggtttccacgtaaagccgggattttttcaccgttgacctcaatcacgccgctggtggtcgcctgtaccgacgccagccccaggcaatccatactaatgccttcaaacgcggcattttgccaggcatcctgaataagctgctggagcaaggccaccatattggcatgttggtcgagggtgacatggtcggctttcgtcgcggcgaacagcaatttatcaatcaccggcgaaaacaagcggcgaaacagagttcgctgaccatagtgaaaactttgcatcagctgcgttaaagcgagacgcatatcattaaacgcctgcggcccgctattaagcggttgcagacagtcgaccagcacaatctggcgatcaaagcgtagaaaatgatttttgtagaaccctttgaccaccttttcgcaatagtagttaaagcgttcgcgcagcattccagcgttggtctgtttatccgcctgcgccagttttgactcgccgaaggcgtccacatccggccacgggaaaaactgcaacgctggcgcgcccgccatatcgcccggcaaaacaaaccgtccaggctgaataaaatgcaatccctgcgatttacactgatgcaaataatccgtccaggcggcggcaatctccgccagccgattttcatcggcgggcgccagcggatcgagcccgtcgcaaagttgccgccattttgcggcccactcagcgcgttgcccttgtaacaagccgttcatctgacgggaccagcttaaataatcctgagccagcatgggcagatcgagtaaccattcccctggatagtccacaatctccagatacaatgtcgaggtatctttaaaatggcgcagcagcgagtcgtttgagcgatagcgcaacgccagccgaatctcactgacgccgcgcgtcggtgtgggccaggcgggaggattgccataaagctgaagtatcccctcgtcgtaggtaaaacggggaataccaaaatcacgttgaggcacgcgctttacgccaagcaggcgttcttcgcgtaccgcgctgagcaacggtaagcgcgcgcccgcgtggacattaagcaactggttaaccatcgccgtgataaacgctgttttaccgctgcggctcaacccggttacggcaagacgcaaatgcctgtctaccccacgattgaccagcgcgttgagttcagttttaagtcgcttcattgacatcctgttgagcctgaagagaagaaaaaataataacgagcctgcgttatagatatgtgcaaaaacgttattatcaactacccggagagatcaacaacggcgcattaagcgccgcggttagtatgagtattgagcaatagattatctatttttttactttcggcatatcaagacgactgatgccgcccatattcatcgcgtgcgtataccccatatcaagcaacatttgttttgccatgcccgactgtcgcccggagttgcaatataactttaccgtatcgttcctgtctggaactaccgtttcgatatgagatttaatctccttcaatgggatattaatcgcgccctgaatatgctctcgttgatattgttccggaatgcggacatctatccagtattctgcggcataaagcggcatggctacgaataacgctaacgcaaatattccttttttcaacatactcccgtcctgacacgtaatgtatttcgcacacactatacgccagagcttaacgaaatattatgaccagactcgctatttgtaacgctgcgaaattttattcgccgccttacgaagtactggctccagcgcaaacgccagcaacatttttagcggacgacgggcgacggattttaccgcccatcccgccacgccggcaggcccgtagcgtaacgcggtcaacagaaccagcttacctgctattttgaagccgggcttcaccttctgcccggcgcgttgccagcgagtattcatcttcaccttcccgatatatcagttacagttgacggaaacgactacgcagtgtgaacgtatctgacgtgacgtagcgttccatttctcgcaaacgcttttcgcctgcggcaagctctctgtctacggtatccagcagttcgccgctggtcggctgcggtttccctgcggccagattatccggcatagggtccagtacaaaagacaggacgatataggccactacggtaaaaaacgccagcccaaagaaaatcgacagcacgaccagaatacgcaccagttttaccggtacatcaaggtagtcggcgatcccggcgcaaacgccacgcaccatgcccttttgcggcatacgccatagttttttattcagattgattccactcattagcgctctctccagttcggatgctctgcatcaagaatatcttccagcgcctgaatgcgctcgcgcatacgttgcgcgtcgtctgtgagttgcagtaagcgttgctgctcgctttgcgacagttctccccgaccggcgcggttgctgtaatgcagccacagccaaatcggtaacacaaacaacacaaaaatggttaacgggatggccagaaatagcgcgctcatgcgttctccttacacctaaagctgatgagcgacggcgcgtaccggcgccgccattgtcattattgattatcttgcttcattttggctttcaactgcgccagctgctcgctgatttcatcatcggctttcaggttggcaaactgttggtccagcgattgctgcttaccaaaacgatggctttccgcttccgcttccatttgatcgatacgacgttcaaaggattcaaaccgcgccatggcttcatccagtttgccgctgtcaagctgacgacggacatcgcgggaagaacttgccgcctgatgacgcagcatcagcgcctgctggcgagcgcgtgtttcgctgagtttgttttccagctcgccaatctctttcttcatgcgcgccagcgtgtcatccaccagcgtgacttcctgttcaagcgtagcaattaaatcggtcagcttttgtttttcaatcaatgcggcgcgcgccagatcgtctttatctttgcgcagagccagttccgctttttcctgccactcggtctgctgagccgtagcctgttcaatacgacgggataactgtttcttttccgctaaagctcgcgcggagttcgagcgaacctccactagcgtatcttccatctcctgaatcatcaggcgcaccagcttctgcggatcttccgctttttccaacaacgcattgatattggcgttcacgatgtcggcaaaacgagaaaaaatacccataattcaatcctcacataatgttctgataacgggcgatgccctgctacatgattaatacaatttgcgtgccaactttttatattattgatagttaaggaattatttcgttttacctcgccagccaaaaaggataaagtggtgaaaaacactaacaagtggcgattttcatcatggctgaatttaaagataacctgctcggcgaggcaaactgttttcttgaagtactggaacaagtctcccggctcgcgccgctggataagccagtgctgattattggcgaacgcggtacgggtaaagaacttatcgccaatcgcctgcactatctctcttcacgctggcaggggccgcttatctcgcttaactgcgcggcgcttaacgaaaatctgctggactccgaactgtttggccatgaagcgggcgcttttaccggggcgcaaaaacgccatcccggtcgttttgaacgcgccgatggcggcacgctgtttttggatgaactggcgacagcgccaatgctggtacaggaaaagctactgcgggtgattgaatatggcgagctagagcgcgtcggcggcagccaaccgttacaggttaatgtgcgattagtatgcgccactaatgccgatttacccgccatggtgaaggaagggacatttcgtgccgatctgctcgacaggctggcttttgacgttgtacaactgccgccgctgcgcgaacgccagagcgatatcatgctgatggccgagcattttgctattcagatgtgtcgtgagctacgtctgcccttatttcctggttttaccgatcgggcaaaagaaacgttgttgcattacgcctggccgggtaatgtccgcgagctgaaaaacgtagtcgaacgttcagtgtatcgccacggcagcagcgaacatcctttggatgaaattgttatcgatccttttcaacgctatcccgccgaaccgcccgcgcccgccctgccagcggcatccgccacgcctgacctgccgctcaacttgcgggagtttcaactgcaacaggaaaaagcgctgctgcaacgtagcttacagcaggcgaaatttaaccagaaacgagccgccgatttgctggcgctcacctaccaccagtttcgcgccttgcttaaaaagcatcagctttagctatttctccggctaattgacgacatttacgccagttatccaccgacatttttacgtggcgggccgaagtgcgatacactttgcaaattgaacttcaaaaacttaactattatgcgcctggttttatcatctctgatcgtgatagcgggtctactgagtagtcaggctacggctgcgactgcgcccgaacaaactgcgagtgcagatattcgcgatagcggctttgtgtattgtgtcagcgggcaggtcaacacctttaatccgcaaaaagcgagtagcggcctcatcgtcgataccctggccgcccagttatatgaccgcctgttggatgtcgatccctatacttatcgtttagtcccagagctggcagaaagctgggaagtgctggataacggggcaacgtaccattttcacctgcgccgcgacgtttcctttcaaaaaaccgcctggtttacgccgacccgaaaactcaatgctgatgatgtcgtctttacctttcagcggattttcgatcgtcgacatccgtggcataacatcaacggcagtagcttcccctactttgatagcctacagttcgccgacaatgtaaaaagcgtgcgtaagctggacaataacaccgttgagtttcgcctgacgcagccagacgcctcctttttatggcatctggccacgcactacgcttccgtcatgtctgctgagtacgccgcgcagcttagccgaaaagatcgtcaggaactgcttgatcggcaaccggtcggcaccgggcctttccagctttcggagtaccgtgccgggcagtttattcgtctccagcgccacgatgggttttggcgcggcaaaccgctaatgccgcaagtggtggtggatttaggctccgggggtattgggcgtttatcgaaattactgaccggtgaatgcgatgttctggcctggcccgccgccagccagctaactattttacgcgacgatccgcgtttgcgtctgacgttgcgcccggggatgaatatcgcctatctggcctttaacaccgacaagccgccgttgaataatcccgcagtgcgccatgcgctggccttatcgatcaacaaccagcgcctgatgcagtcgatttattacggcacggcggaaaccgcagcctccattttaccgagagcctcatgggcttacgataacgatgccaaaattacggagtacaatccgcaaaaatcgcgcgaacaactaaaagcgctgggcattgagaatcttacgctgcatctctgggtgccgaccagttctcaggcctggaacccaagcccgctaaaaacggcggagcttattcaggcggatatggcgcaagttggcgtaaaagtggtcattgtgccggttgaaggtcgttttcaggaggcgcgcctgatggatatgaatcacgatctgaccttatccggctgggccacggacagcaacgatccggatagctttttcagaccgctgttaagctgtgcggccatcaattcgcaaaccaatttcgcccactggtgtaaccctgaatttgacagcgtgctgcgtaaggcactgtcgtcgcagcagttggcttcgcgcatagaagcgtatgacgaagcgcagaatatcctggagaaagagctgccgatactgccgctggcatcatcactacgcttacaggcttaccgctacgatattaaaggactggtgttaagcccgttcggcaatgcgtcttttgccggcgtctcccgcgaaaaacacgaagaggtgaaaaaaccatgattatcttcaccctgcgtcggttattgctgttgctggtgacgctattcttcctgacctttatcggctttagcctgagctattttacgccgcacgcgccgctacaaggcgcatcattatggaatgcctgggttttctggttcaacggtctgctgcactgggactttggcgtgtccagcattaacggccagctgatctccgaacagcttaaagaggtgtttcccgccacgatggagctgtgcattctcgcctttggttttgcgctgatggtcggcatcccggtcgggatgctggctggcgtgacgcgtagcaaatggccggatcgttttatcagcgcgctggcgctattaggtttctcaattccggttttctggctggcgcttctgctcacactgttcttttcgctcacactggggtggctgccggtatccgggcgatttgacctgctttatgaagttaaaccggttaccggtttcgccatcattgacgcctggatttcagattcgccgtggcgtgatgaaatggtaatgagcgccatacgacatatggttttaccggtgctcacgctttccgtcgcgccgaccacagaggtgatccgcctgatgcgaatcagcactattgaggtctacgatcagaactacgttaaagcggcggccacgcgcggcttgtcgcgctttacgattttacgccgtcacgtgttgcataatgcgctgccgccggtcattccccgtcttggtctgcagttttcaaccatgttaacgctggcgatgattaccgaaatggttttcagctggccagggctgggacgatggttaattcacgccattcgtcagcaggactatgccgctatttccgctggcgtgatggtcattgggtcgctggttattgtggtcaatgtgatttccgatattttgggtgctatggctaaccctctgaaacataaggaatggtatgccttacgataagaagcaataaaaatatcattaaatcaaaaagttatgcttttatttttgtgataagttcgttttttagtacgtaaatatatacatattgttttctattttctccggcagtccatgcttcgatgatgattgccggagatttatcttctctatcagcgcctccgggtttcactgcgtgatgctgcaggaagttttctgtacagcgtcgacagcccccataaataatcgctacctgctgtcgcggtacttctgacccaatcagacgccgggcctgcgcctattgttccaatgttagtttcggtcgtcggccaccattacgccccctcgcccttgccgcttccagtccagcgcgggttctttccacaatcaattcacgttccatttcagcgagtgcgcccatgacatgaaagaagaatcgccccattggcgtcgacgtgtctatgctgtcggtcaggctgcggacattaacgccgcgttcgcgcaattcttctaccagaacgaccagatgacgcatactgcgacccaggcgatcacgcttccatacaaccagtatgtccccttatgataacgtcctgactaaaaggaacaggcttcacgggctggatttatccaacaaagcgcgtagtgagtgcttcccgttagcctgaatacgaaaaaggccacgtaaatgcgcagcctttatggtgagagttctaatcttaagaggcactccatcaaacaaaccacccacagttgtcagaagcttgaaggagtgctttggggtgacagtatctgcggcattgttgccacgaacaacgttcccgcaaatgctcaaaatacaatcccaaaatccgctccagtaaacggtctgaatatcgttgccccacagatcgctacagccatacaggaacctgataaaggttcagacataatcgtctcaccaacaagattaagcctgttctttagagcgtttaatacccagcaacatttaatttgtcaccgtaggccccatacaataacttgatgagctacaagtagttatcgcaattaattccctggaagagaatgcacttttgaaatcggggtcgcgccaaacattctctttataatatatccttacatccccccctgttgtataataatactttgctgtatttagcatgttatcaaacccctgtttatgattcccgtacacatccactttacacatggcattgatactaatagcttcactcccgtgcttcagtccgatacaaaaaaactgagtttccttaccccctgacgtatacacaccataagacaggttgttaatctgaacattactcacatacgtatcataatcagccatagctgcataacaaacactggatattgacgcaagagcaagagtcagaacctttaatttctttttcataatccactccaacaatatttaccatacttgtatttctatcgtaaacaagctcaactgcttcatggatattttcaattgggatagaatttacagatacatactcactttgtaaccgcatcatcactcgctcaaaatgaccaaactggataccacataactcaatataagcaacagacggcggaaggctgtagaaactattgtctgcacggattctgtatctgtacaacctgccgctaaatgttgctctggagtaatataatcgtgctatattataagcctcattaatatctgagatagtcgcaatatagtactgtctcgactaccggatacacaggagtcatctcttatatgttgctgaagattcctgttatttccgtgagaagcaaaaccatcccgaaaaatcacatctgaaggtctcgagtcaacacgatatacaaaatcaacggcacctgaatgaccaaaaaaatactaaaaataatattacttttttatcatactctctcctacagaaactatcaggcaaaccacctaatgtgttaaaccgagtgctaaccatagctcagtcatactttacgtctcgctggataaaattagaaaaacaaacctccccggtttacgggcacgaaaatcccggtaattgcgcaatgccgatccttaaactgcggcactataacggcttcccctacagggagccgttttgttatgtcacttctcaatgacctgctcgatttcagcgaccatccccttatgccaccgccttcagcgcagatgtttgcggaacatcttcctgctgagtgtatacaacactgcctgacgctctctaagcatgcaaccgttcgcctggcgttcggctttatccgcctggtgtttacctctgatacacctggctgcggctttactcttttctttggcacgcagttccagcgcgtagatagcaccatgttcaggacagcaccagacaacgttgctgtaagcaggaggaaaccattcccgacaaactttgcatttacggcgcggtaatttagccatgctcacctcagacccggttacggatatagcatctaataacgttagattatgcatgcctgacattgttaggcgagaatacggaagagtaataattcatagcatatctatattaatgcaaataaaatacagtcaacagatttctccaattttattatatataaacagaggcttacgttgagtaataacaagatcatacaatcccgcaccagtaaaattaatgtaaaaacaggcgtaatcatgtattaatattgactggacagcaggtaagtgataacaaataaatattaaaaagtaaatatcacataataaccattatcactacatgagaggtgaatatgatgaaacctatttctgccgcgatcctcaatattagaggggcagcccccggcactgccactatcggaaatggcgcaactaacctagccaaagatattattagggtagctaatattgcttataatatttcacaggttgagcaaaaaagtggtttcttgttagtaacgggagagaaaggcttcaacaaatctgcttgcctgcatatgctgggacaacaaatatccagagttttttctgggaagcacttatatcctggtgtttttataagtaaagacgcagcgtccgaatttgaaaaaacaatcagcactcattataaaactctttcgggtcacattgatctgcaacaatacactaatgatgtaaattgcggagcagctgtaggtattgttgcacggcagcaagaaaacctcatactagatgagatcacattaagtacgtttaaaaaggtctatgttaggtttttacgatattgtaaactgacagttactgtataaataatcggtaactgtcagctcacatctgagctaataaatatcattccccctgctgacccgctgcagcagtttaagacgcaacacctcatgccggagtattccgatctgtcttattgtgaacctcccaaagactaatgccgcaactgaacacaaactccgccagatactttaagccggactattccccggatgccgccgcgcgccgcttctacaaatactgcaacatcctgatcgcgccatacttcaaactagtgccagacgccactgtcggtcttaatgaccctggcccaaattccgtacagtgctaaaacttctcccagtagtcgtatgttcttttacggttaacgcttctgtttttttcttcttctccagcaccatctggcgacgaggatcgagtccctcagttaaccatgatctaaagtactgacggcgttccctggcatgagatagtgatatggttggataatcgccaatcgtcagttgagcagcgttcccgttccatctgtatcggtaaaagaatgttatactgccggatgtagagagcctgacattgagaccatgagcgtctgagatgaccttgatttggtctctttttttgccaggagcctttcttaattttgtatcggcaagcaatgtgtacactccataagaggatatacacatctgtgtatacattttgcataaattgataaccttcacattaatgcaaagtacacaaaattgagacgcttacaatccataaccaattgatagtgcttgaaaatttcaaaagacataaagcatggtaaacaaaaataaaacgagtaaatatgccttacgatagcgtctacagcgaaaagcgcccgccaggcaccctgcgcactgcctggcgtaaattttatagcgacgcgcctgcgatggtgggtctgtatggatgcgccggtctggcgttgctgtgtatttttggcggctggatcgcgccctatggtatcgatcagcaatttctgggctatcagctactgccaccctcctggtcacgctatggcgaagtctccttttttctggggactgacgatctggggcgcgatgtgctgagccgcctgttaagcggcgcggcgcccacggtcggcggcgcgtttatcgtaacgctggcggctacgctatgtggattagtcctcggcgtagtggcaggcgcgacccacggtttacgctctgccgtactgaaccatattctggacacgctgctttccatcccttcgctcttgctggcgattatcgttgtggcatttgccggcccacatctgtcacacgcgatgtttgccgtctggctggccctgttgccgcgaatggtacgttccgtctatagcatggtgcatgatgaactggaaaaagagtacgtcattgctgcccgtctggatggcgcgacaacactgaatattctgtggttcgccattttaccgaatattaccgccggtctggtcaccgaaattacccgggcgctgtcgatggcgattctggacatcgccgcgctgggatttttagatctcggcgcgcagcttccctctcctgaatggggcgccatgttgggggatgcgctggagttaatctatgtcgcgccgtggaccgttatgctacccggcgcggcgataacgctcagtgttttactggtaaacctgctcggagatgggattcgtcgtgcgattattgcgggggtggaataatgccgttactggatatccgcaatctcaccattgaatttaaaaccagcgaaggttgggtaaaagcggtcgatcgcgtcagtatgacattaagcgaaggtgaaattcgcggcctggtaggtgaatcgggttccggaaagagcttgattgctaaagctatttgcggcgtcgcgaaagacaactggcgagtcactgccgaccgtatgcgttttgatgatatcgatctgctgcgcctctcctctcgtgaacggcgtaagctggtcgggcataatgtgtcgatgatcttccaggagccgcagtcgtgccttgatccttccgaacgcgtcggccgccagttaatgcaaaatattcccgcctggacctataaaggccgctggtggcagcgtttaggctggcgtaaacggcgtgcaattgaattactgcaccgggtgggaattaaagatcataaagacgcgatgcgcagttttccctatgaactaaccgatggcgagtgtcagaaagttatgatcgctatcgcgctggcgaatcaaccgcgactcctgatcgctgatgaacccaccaactcaatggaaccgacgacgcaggcgcaaatttttcgcctgttgacgcgactgaatcaaaacagtaataccaccattctgttgattagccacgacctgcaaatgctgagtcagtgggctgacaaaatcaacgtcttatactgcggccagacggtagaaaccgcgccaagtaaagatctggtgacgacaccacatcatccttatacgcaggcgcttatccgtgcgattccggattttggcagcgcgatgccgcataaaagccgtctgaatacgctgccgggcgcgatcccgctactggagcagttaccgataggttgtcgtctggggccgcgccgcccttacgcgcaacgagaatgcattatcacgccacgcttaaccggcgcgaaaaatcatctctatgcctgtcattttccgctgaatatggagagagagtgatatggtggaaactctgcttgaagtgcgcaacctgagtaaaacctttcgctaccgaacaggatggtttcgccgccagaccgtcgacgccgtgaaaccattaagctttacgcttcgtgagcgtcagaccctggccattatcggcgaaaacggttccggcaaatccacgttggcaaagatgctggccggcatgattgaacccaccagcggcgagcttcttattgacgatcatcccctgcattacggcgactattcgtttcgaagccaacgtattcgaatgatttttcaggacccttcaacgtcactgaatccacgtcaacgtatttcacagattcttgacttccccctgcgccttaataccgttctggagccggaacagcggcgcaaacagattgtcgagacgatgcgtatggtggggctattgcccgatcacgtgagctactacccgcatatgctggcgccgggacagaaacaacgtctgggtctggcccgcgcgctgattttacgcccaaaagtcattatcgcggacgaagcgctggcttcgcttgatatgtccatgcgctcgcagctcatcaatctgatgcttgaattgcaggaaaaacgaggcatctcctatatctacgtcacgcagcatatcggcatgatgaaacatattagcgatcaggtattagtgatgcatcagggggtagtggttgaacgcggcagcaccgccgatgtgctcgcctctccgctacatgagcttacccgccgtttaatcgcaggccattttggcgaggcgctgaccgctgacgcatggcgaaaggatcgctaagcgacacaaataccctcagttcgattctctgagggtgttcacgcgacggcccaacagcaatgtttcaacctcttctaacgcaacggaaggaaataacgtgccctgggttgcccaaatgcctgccgtttttaacgccggcaaatagcgtgtgttttcctggccacccaccacgatcttgtcacaataacgccggatatgtttgacaagcagcggaaacgtcattttttcaatttgtgagataaaaaagctgcgatcaagttttacgccgctaaaacacccgcaaactaatggcgcagcggttgcgttccctacgcccaggtcgcccagccataatggattaggttgcttatgaagcgcgtgtattaaaggatcgattaaggcgttatcttgacatgaaaaatgttcagcgacctgcaactccacaaatagcatggcgtgtagtaatgcgcgaatatctttgtcctgaaggacaagctgcgccataccccgatcgatatttacgatacagaacaggccgtggcgtagaaaccagccatgtttggccgcgattgtccgcaacagatcaagcagaaaacggcgcttctgcgaattgtcccatgacgagataacaaactcagggtgtagcggacgagcgggcgacgatgcaaaatgggtagtgatttcgacacccagtaaatccccctccattgcccttatcggctctgccataaaaaaatagcgcatgtgaccactccacttgatcttaactccctgataatgcgcttttaacgcaaatcaatcagtaaaaacgatcaatatctaaaaaatgatcgaaaaaaacaatatatattaacttcatgataacttgctaattttatgttttgagaatgttcttctattgctataagtaaatttacatactacgccgaacaacgctaatacgacggcatgagaccatccgtaaagccaggtttttcttgtcaggaagaggggaaaaatcaaggcgagttaatagtgttgcaccatcgcgtggcatttcacccactatggcagcgcggcatcgccaaccctagtggcgagttgcatctccgctacaggctgtccagatcccccgaacgacctttaagcgaatagcaactctcaataattgattggtaaatctgtagcgaatgtgcccccggcgattcgcagaaaagaacggaactaaatgctatttttttaattcatcctttaataccttagccacaagagtcccttcctccggcgcggctagtttaaaacgtcttcctggcgcaggtgcctgttcttcctctccgattaactcatcaagttctgtaataagtgacttataatattcaatatcttcagtatttccttcggtctcggactgctttaattttaccaggtaacgggccttaatttgctcttccagttgccttgttgcaagagaaacgcttcgctgttgccgggattcttgtgacagcacgatttgatcgccatcgacaaagaaaagtaccccctctttaatcagaatattacctacgttatctatatcatgcatataaaccccccgggattcaagaagcgcctccgccattcgatagttatcttcatcttcaatatcgaactcctgaccttgaatatattttgaaactaaaactgtaacgtctttaccattaatattcatggaggccgaacgagaaaaattcttgtcgtcattggccatattcaaatacttactgacacgatcaggatgacaattacgatgctccggagagttaacatccacttttattccccgctcattaattggaatcttaacaacaaagtcatcatgtaaccgatagactgtcccataacttccgctacctattttatttttttcaatatcacgcatgcgaatatttttctgaaactccggcgagttaataaacgcctctattgccgctggttgtgatgtatctgtctgatcaatagcgccgctctcatcaccagacgccgtggcgggcgtggcgggcgtggtcaggaagtctatcaaacgatgctcaaaagcctcatagatcccattactacctgcttcgctcggcgtcaggtgatcattatctaaagcggcaagcgtaatttccccggaattataattaaacatcgtttcttttaaaaaatcgacgcaacgctcagagcactccgtctcggtcactaacattccatcataaaacatctgtagtagtaacatattttcttgatgtgctaatacctctacagtgtatttatctcttgtttcaggcctggaggcatcaataagtttaatatatccaagaagggggcgccatcgtgtacagtcttcatctcgcttcgaaaatggtcgtagcgagaaaggcttcgtaatatctggacgctcgtttttttggcacagtagattatagatttctctataatcagagattaaacttcgactggtaaatatattcctgaaaaaatctatgaacttctcatacgttgaaaaaacatgctctcttttatgatcaatgatatctcttaaatgtctttctgatatctggcaactatgatttccgatctgaaatgtaaacggcatatgtctcatcctctgaaaatttattataatatacatgcaaacatataaaaacctgatttgtaactactgtaatcacctgctttccaaaatttttcatattcagtattactctgcatcaataaatagagaaaaccttcagcgcctaaaaaagaaattatttttgttaagcatttgctggttaaaattacatgtccataacatcgctaataggtgaggtaaaccatttggatgaatattcaggcttcctacagaacctttatttgtctggtggaaggcgcatcgctatcgtacttgctgtccgtcccggtgtctctggttggatgaggcgaaccttacaccagctggtatactgcaccgtagggcctgtcccattagactctttgatttgccagtttggccctggggagtgctcaaaatcctcagggacttcgttaccgtgtggttttagaacgtcacctgccggagatagcggcggaaaaatagcgtgacacacggggccaggagtgggatataatttcagactaatttcgaataatgttgaaaagttgctgttaaccattgttcgtaaaagcaaaaaataagcaatgactataaggattaaagctatgggttttctttccggtaagcgcattctggtcactggcgtggccagtaaactgtccatcgcctacggtatcgcacaggcgatgcaccgcgaaggagctgaactggcgttcacctaccagaacgacaaactgaaaggccgcgtagaagaatttgctgcccagctgggttccagcatcgttttaccgtgtgatgtcgctgaagatgccagcattgacgctatgtttgcggagctgggtaacgtttggccgaaatttgacggtttcgttcactcgatcggtttcgcgcctggcgatcagctggacggcgattatgttaatgcggttacccgcgaaggctttaaaatcgctcacgatattagctcttacagttttgttgccatggcgaaagcctgccgcaccatgctgaatccgggttctgcgctgttgaccttgtcttatctgggagcggagcgcgccatcccgaactacaatgtcatgggtctggcgaaagcctctctggaagccaacgtgcgttatatggcaaacgctatgggaccggaaggggttcgcgtcaacgccatctctgcgggcccgatccgcacgctggcggcgtccggtattaaagacttccgtaaaatgctggcgcattgtgaagccgttacgccaattcgtcgcaccgtgaccattgaagatgtgggtaactcagcggcgtttctgtgttccgatctctcggcaggcatttctggcgaagtcgtccatgttgacggcgggttcagcattgcggcaatgaatgaactggaactgaagtaagcgcattaagtttattagcgggcggcacggctgtgctgccccattcccctcactcaccgctcatctcgttatatagcgttctgatatttgttatcacctaacaatctttcatccctttcccgcatacgccaggataatccagcataaacgatccgacgccgaatcattatcgatcgccatttcatcctcgggaaaccctatggaacaatgccgaaaagcgggtaaaagccactggtatcatgaaacacaatccactatgtcgtcacaaactccgctttcgctgatgccggaagccgcgtatgttaacgatcgatttttactggatttagcggtagcagaaaccgcgttgacgccttttgagtcatggttaaagccagctcgccagttggcggatgtcttatttccccgcacggttctcaacgaccggcttcatacgtttagcgcctatgaacgtatgagcaccgcccttaccgccgctcaggtatttggggttcagcgtttgtgccgccattatgccgcacgtctggcgccgctacccggccctgacgcctcaagagaaagcaatcaacggctggcgcaaattacgcaatacgctcgtcagcttgccggctccccctccgttatcaatacgcgagcccgcgaacagcttgcagaggtgggattaaccgcccgggataccgtactcatcaatcagatcattgggtttatcggttttcaggcgcgagtagcggcgatatttcaggcgttttgccgtctgcccgtgcgcgagctgcccggccaggagatgcagcgctttgccagggccgcgcggtttcaaaacccccagacgacatggcggcccgccgccagtctggtagaatatcctctcgcccataccaaagttcggcggcaatattcgtcttcacaatgccaaataatggcgccggtactcatgcgcgatccgtcttcattcgcgttactcgaacgcatactgaccagcacattacacactgcgtcgcccccttctttacttccacttatcacgctcctcacatcacgtatcaacggcagcgccgcctgctttaacgaacaggcaacccaacctggcgcgtggcgccgtgctgtcatcacgttacgctaggaagacgacgacatcgctcgttgggaacttgagcccgcgctgacacaggcgatacaatggctcaccagagcgcccgatcgctttagcgccgcgcattttttcccgctactcaccaggggagtttcatcggagcaggccattaatatgttaggctggtgtggcgtgtgcggatggttaaatcgtttaaaaatcgcgttgggcgaaacctattaactcatccattactgaaagagcgcttgctgcgccaggcagaatcgcgtaaaactgtcagccgctcttttggctacgaaaatagacgaatatgtttcaggacaacccgctgctagcgcagcttaaacagcaactgcattcccagacgccgcgcgctgaaggggtcgtaaaagccacggaaaaaggctttggcttccttgaggttgacgcgcaaaaaagctacttcattcctccgccgcagatgaaaaaagtgatgcatggcgatcgtatcgtcgcggtcatccacacggaaaaagaacgtgagtctgccgagccggaagaactgatcgaaccgttcctgacgcgctttgtgggaaaagttcagggtaaaaatgaccgcctgtccatcgtgccagatcatccgttgctgaaagacgcgattccctgccgcgccgcgcgcggcgttcagcatgagttcaaagaaggtgactgggcggttgccgaaatgcgccgccatccgcttaaaggcgaccgttcgttttacgccgatttaacgcagtacatcacctttgccgacgatcactttgttccctggtgggttacgcttgcccgccataacctggaaaaagaagcgccgaacggcgtagcgacggagatgctggacgaagggctggagcgccaggatcttaccgcgctgaatttcgtcactatcgatagcgccagcactgaagatatggatgacgcgctttatgctgaggaattagcggacggcagactccagcttacggtggctatcgccgatcctaccgcctggattgccgaaggcagtaagctggataacgccgcgaaaattcgcgccttcaccaactacctgccgggcttcaatattcctatgctgccacgtgagctgtctgacgatctgtgttcgctgcgcgccaacgaagtgcgtccggcgctcgcctgtcgcatgatcatcgccgcggacggcaccattgacgatgatattgccttttttgcggccaccatcgaatcgaaggccaagctggtgtacgacaatgtctccgactggctggaaaataacagcacctggcagccggagaacgaaggcattgcccagcagattcgtctgttgcaccgtatttgtctaagccgcagtgagtggcgtcatcatcatgcgttagtctttaaagaccgcccggattaccgctttgtgcttggcgaaaaaggcgaagtactggatattgtggcggaaccgcgccgtatcgctaaccgtatcgtagaagagtcgatgatcgccgctaacctttgcgccgcgcgcgtactgcgcgataagctcggtttcggtatttacaacgtacatacgggcttcgatcccgcgaatgccgacgcgctggccgcgctgctgaaaacgcatggtctgcatgtcgatgccgaagaggtgctgacgctggaaggcttctgtaaactgcgtcgcgaactggatgcgcagccctccggtttccttgacagccgcattcgtcgcttccagtcttttgcggaaatcagcaccgagccggggccgcatttcggtcttggtcttgaggcttatgccacctggacctctcccatccgtaagtatggcgatatgattaaccatcgcctgctgaaagcggtcatcaagggggaagctattgcgcgtccgcaggaagatatcacccagcaaatggcggaacgccgtcgcctgaaccgcatggcggagcgcgatgtcggcgactggttatatgcacgcttccttaacgataaggcggggacaaatacccgtttcgcggcagaaattattgacgtcagccgcggtggtatgcgtgtgcgactggtcgataacggcgctatcgcctttatccctgccccgttcctgcacgccgttcgcgatgaactggtatgcagccaggaaaacggtacggtacagattaaaggtgagacggtttataaagtgacggatgtcattgatgtcactattgcggaagttcgcatggaaacccgcagcattattgcccgaccggcagcgtaaccacgcttagctcgctcaacggcctttgctgagaaggcaaaggccgtttcttttcttcttctcccttccgtcatgctctaagtttaatcttattcaagcgccccatttcttgttatttttagctggcgactatgctttttccagaatctggattacatatgaatacatagataaaacaatatgttcagccataattacccttatttataacatggctaacctttcttttcgggcacctggcgcttaaatgggatggtacgcatgatgaaacagattcaggaacaaacggcgctaaatccccttcactctcactggcgtctggctgatgaccgcaacgtgctgtatctctccccgacaggtgaaacggatgcagaaaaaacggttgagctatcgccggagcaagccgggcgtatccgggaaataacggcgattacgtccagtctgctgataacgttgttgatagaaaaacaggttaccgctgtgcacctggtaggccgtaagattaataaccgtgaatgggctggcagcctggcaacctggcctgatacgcctgccgtcgcgccaacgcaggcgcaggaactctcttttgccgagcaaatcgtatcagaagccaactcagtcattgcgatactggatagtcggggaaaaatctgtcgatttaatcggttatgcgaagagtacacgggcttaaaagagcgagatgtaattggtcaaagcgtatttaaattatttatgagtcgccgggaggcggttgcctcccgacactacattgagaatttttttcgcaatggcaatgcctatgaaatcgaacgctggataaagactcgtaaaggccaacgtctgttcttatttcgtaataaattcgtccataacggtagcggaaaaaacgaaatctttctgatctgcgcaggcacggatatcaccgaagaaaggcgggctcaggagcgtttacgcatactggcgaatacagacaccgtcaccggcctgcccaatcgcaatgctattcatgaatttattaatcatgctattgcctcggctggcgagtcgcaggtgggtatcgtttatctcgatctggataacttcaagaaaattaatgacgcctatgggcatatgtttggcgatcagctcttacaggccgtttcactggcgctgttgagttgtctggaggaagatcaattgctggccagactggggggagatgaattcattgtcctcgttgcccatacgtctcaggccgcgctggaagcagtagcctcacgaatccttacccggctgcggcaaccgtttcgcattggactcattgaagtttacacgggatgcgccattggcatttcgttggccccccggcacggacaggacagcgaaagtctcattcgcactgccgacaccgcaatgtataacgccaaagaaggcggccgcggtcagttctgcgttttttcgccggaaatgaatcagcgcgtatttgactatcactggctggatacaaacctgcgaaaagcgctggaaaacgaccagttacttattcactatcagcccaaaattacctggcgcggcgaagtacgtagcctggaagcgctggtacgctggcaatcgccggaacgcggattaattccgccgctggagttcatctcatacgccgaagagtcaggactcatcgtcccgctgggccgctgggtgattctggatgtagttcgccagattgcgaaatggcgcgataaggggattaacttgcgcgtagccgttaacttttcggcgcgacaactggccgaccagacgctttttactgcgcttaaacaggctttgtacgatctgaattttgagtattgcccaatcgatgtcgagctaacggaaagctgcctgatcgaaaacgacacgctggcgctatcggttatccagcaatttagtcagctcggcgcccagattcatctggatgattttggcacagggtattcttcgctttctcaactcgcccggttccctattgatgccgttaaactggatcaggctttcgtcagagatatccataagcaaccgctgtcgcaatctctggttcgggcgattgtcgcggtggctcaggcgctaaatttacaagtgattgccgaaggcgtggaaaatgctaaagaagatgccttcctgacaaaaaacggcgtcaatgaacgacagggctttttattcgccaaacctatgcccgccgtttcttttgaacgctggtacaaacgttatcagacgaaaaaaatgcgttaatggcggcgataatagggagaacagcctgtgcagacaggcatagccctatttttcccttctcttttcagattaatttctgcatcatgaattgaaaccttttctgacattaaggatgacaaacatgtctgatatcgaagcacaacgaattgccgcacgcattgataccgtgctggatatccttgttgctggcgattaccactcggccatcaataaccttgaaatattgagagcagagctgttagatcaggttaaagacggtatctcgccatcccaggctcccgggtcgccctgggaaatctgatagcgattatttgtccgggatggccgttagcccttcccggctctctgactgtctgttgactcctcttaacgaataaaattaatactatgaactcccgacaacaatcaattttgcaaatggtggttgataaaggccagatgagcgttgctgaactggcgaaaattaccggcgtatctgaagtcacgattcgtcaggatctgaataccctggaaaaacagagctatttacgccgtgcgcacggtttcgccgtttcgcttgagagcgatgacgtagagactcgcatgatgacgaactacacgctaaaacgccgactggcggagttcgccgcctcgctggtcagtcctggggaatccgtttttattgaaaatggcagtagcaatgcgctattggcccggacgctggcggaacaaaaagatgtcacgatcatcaccgtgagcagttatatcgcgcatctgctcaaagaaaccccttgcgaagtcattctcctcggtggaatctatcagaaaaaaagtgaaagcatggtagggccgttgacgcgacagtttatccatcaagtgcatttcagcaaagcatttatcggtattgatggctggcaggctgataccggctttaccggacgcgatatgatgcgatcggatgtggttaacgctgttctggaaaaaggctcagaagcgattgtcctcaccgacagctccaaatttggctgtgtgcatccctatcccctgggcccgctctctcgcttccatcgtgtcattacggattccaaaatttccgccagcgatcaaatgcagttagagcatgcagggctgctagtcaatgttattggctcatccgtttaaaatatttcccgatggtttgccctctatggcaaatcatcctctctctaagacttttctgacatcccaattaagactatttacctgttgtaacgagcgtaacgtcgtaaaattaatattagcgaaataacaggaagtgactatcacctgcgtgatatacccctgcgcaatcaggttttacggaaaatctcttaacatgttttattttaactatagttatagtgagcttaattccgtgaatcgttaattcaggagagagtattatgtttatgatgagcaaaaaaatggccgctgctgtgctggcaatcaccgtagcaatgtctctgagcgcctgctcaaactggtccaagcgcgatcgcaacacggctattggcgcaggtgcgggggcgttaggcggcgcagtgttaacggacggcagtacattaggcaccctgggcggcgcggcggtcggcggcgtgattggtcaccaggttggaaaataatccagacgtttaaatattgaacggctcaaaataatacgtttattcttttcaggtctggattacaaaaatagacaaagttgacttttacgccacggcaatttacaaccgtggcgttttcattagccgccagctaattttactttcattcctttagcttccagcaatgattttatcaagtcgcgtttatcaccctgaatttcaataatcccttcttttactgccccgccacagccgcattttttcttcagttcagccgccagtttggttaattccgcatcattcatctcgataccggtaatcaaacatacgcctttacccttacggccactggtttgacgctgaatgcgaacgataccatcccctttgggacgaaccggcgccgttttaggttcttcaatgcgccccgtctgtgttgaataaaccagacgactattggaatcgctcattatgcctcccgtttcagtgacgcgttaatatccttcagcgtttgcgccggatctaccgattgcgtaaccgggcggccaatcaccatatagtcgacgccagcggataatgcctgttcgggcgtcataatgcgtcgctggtcgcctgcctcgctgcctgcgggccgaatgcccggcgtcaccagcttaaatgcagcgccaaaggcctgtttaaatctgacagcttcctgagcggaacagaccacgccatccagcccgcattgctgcgtcaggcgcgccagccgctccgcatgttccgccggtgacaacgtcacgcccagatcgtgtagatcgctggttcccatactggtcaacacggtcacggcaatgagcaacggcgcatctttactgaatggcgccagcgcgtcgcgcgctgcggccatcattctcgccccaccagacgcgtgaacgtttaccatccaaacgcccaggtctgccgctgcggcgactgcccgggccgtggtgttgggaatatcatgaaattttagatcaagaaagacatcaaacccacgttgctggagatcccgaacgagttgtggaccaaacagcgtgaacatctctttgcccacttttaagcgacaatcgcgaggatcgattttatcgacaaacgccagggctttatcgcgttcatggtaatccaacgccacaacgacaggcgattcagtaatagcgcaggaagaagatgaagcagtaaacgtcatgaccagaccttcttgatgatgggcaccggaagtggcgcaaattggataaacggcgtgcattctacctgcggcgcagggaaattaacaggttcgattgacaacctgataagccctggccgccgatgccagcgtcgtttcttgtcttatgtcattaagtatgttgtaactaaagtgaggttttttttatatactactgcccatcaagtccgcgaataggtttaatggtcgaccatgcccggcaggacggacagtgccagtacaaggtataggcggtaaaaccgcatttctgacaacgataccgcggtttactgcgcacctgctcgccaaccatatcacgcagtaccatcaggctttctttcgctcgcccttcttccgcctcattgagatggtaatccatcagcttatggaacacccgcatggtaggatgtcgctgtagctgacgcgtgatatagacttgagctgcgtcactaccttcacgcgcttccagaatatcggcaagcattaactcagcgccagcaccggtattctcctcaacggcgcgacgtaaaaactccgcccactcggcatttttaccgagctgttgataacaggtttgcaacatctccagcgtttcgctgaccagctctttatcctgaacgatcacacgttgcaggctttcgaccgctttggcgtaatcccctctcgccatataaacgcgccccatcatgatagacacccgggcgctatttttatctgcggcggcaccttttttcagcaacgccatcgcgcgatccatgtcgtcgttgcccatctgctgtaacgctaactcacagtaaaagtgggcgatttcgatacgctgtttatctttgcccagtttcaccagccgttctgctacttcgatcgccttttgccagtcgctggttagctgatagatttgcaagagctgctgtaacgcgcctacgcgaaattccgtttcgtcggtaagttggttaaacatatcttccgcgcggtcatataaaccggcggccatatagtcgcgccccagttgctgaacagccagtaaacgctgttcataggtcaatgaagcgctttccatgagcgtttgatgaatacgaatggcgcgatcgacttcgccgcgagagcgaaacaaattaccgagagtgagatgagcctcaacggtgccggtatcctctttaagcatatcgaggaacagatccaccgctttatcttgttggttactcagcaggaagttaacccctgcgacataatcgcgcgacaggcggttagcttcatcctgttttgtttgttgcgcacttctgcgacccatataccacccataggcagcggctacaggcaacagcagaaataacaactccaacataaatgattattcctttacaaccgacgaatcggcagggaccgcaacgtcggttgctggcgagagcttgttttccagtcgtttaattttacgttcagcgcgggcaagggaaacgcggatccgcagccagaacaggccgcaaatcagccagccaatcgcaaaaccgacggcgaacagcacagcaagcaacgtggagatacgatactccccttgcgccagcaggtagttaaacgtcacctgttgatcattctgcgcgcccagcgtcaccgaaataacaaaaatcgccaataccagtaagaaaatgagtaaatatttcacattacttcccgttatgtggtttgcgcgaataaatcgtgtccaacttaccgcatccagccttctaaattaccattttcccgcctcgcgcgaaatggaaatgcgcccaccatcagatgatttaagggcaatagtcagaaaatcaaccgttgtcagctttcctgctcgcgttcagcaatttcttgcgcttcttcgcgaggcggcataagcggcccgcaaattcgctgcgccagccaggtcgccagggtaactaatagccaggagatgagcgtggcgaccactaaatctcgcggccagtgcattcccagaagcaaacggctgcccattacgccggtcgcccagactaacaaaaacgcgatggtgaaagtccgtctgcgcggccataacagacccacggccaaaagcgcccagctcgctgcaaacatggtgtgtccggagggaaacgcaaagcccgtctctttttgccagtgctgacgcaggaaaacggggatgttctgttgcccggccaactgctctttcactaaatgtccgcgttctgtacgctttaaagtgtagaactcatcgacgggaatatggtgcgttttttcaagccagaccacaaatggccgcggctcctgtacgcgctcctttacccatgacttcacgccctgcccgacgataatcgccccaccgagaatcgcaaacagcataatggcggcgcgcaggcgaaatcgcaggcaccataagaaccatccacaaagaatcacatgcgtgataacgccccagggtttggtcacggtttccgttatccagaatagcgtttttagccaccagacctgatgtcctggctgccactgccagcctgatacccatacggcaagcggcatgataagcaacagggcggcgcctgccgcggtgcgcctcgcaattgaaagcatggatgctccttttataagtaagtatcacaatcataactgaaaattctcgccggactggaaaattgacaaatttgtgccattcctgagcaattacgtggtagtgattaggtgatgaccgccgccttatggcaaaatagcgggatacaggccaacaggcgacgacaccgcaggcgtcagcataatctggagaaatacatgcagcttaaacgtgtggcagaagccaaactgccaaccccattgggtgactttctgatggtgggatttgaagaactggcaaccggacacgaccatgccgcgctggtttttggcgatatttcaggtaaaacgccagtactggctcgcgttcattccgaatgtcttaccggggacgcgctttttagtctgcgctgtgattgtggttttcaactggaagccgcgctgacgcatattgcggaagaaggacgcggtattctgatttaccaccgtcaggaaggccgcaatatcggcctgcttaataaaattcgcgcttatgcgttacaggatcaaggctatgacacggtggaggccaatcatcagctcggctttgccgccgatgagcgtgatttcaccctgtgcgcggatatgttcaaattactcggcgtggatgaagttcgcctactgaccaataatccgaagaaagtcgaaatactgaccgaggcgggaattaatatcgtggaacgcgttccgctcattgtgggtcgtaatccaaataatgagcattatctcgatactaaagcggccaaaatgggccacctgctaagcaagtaagccaccggtattaaagcgcgggcctgcctgtttacggcaggcccgataaacggctttagttcagcatatttctaatgacatagtgcaatatgccgtcattctggtagtaagtcagctcggtggcggtatcaatgcgacagcgacaaggcaccgtttctttgctgccgtccgctctcgttaacataaccggaatggtcgcgccagggcgcagattttgcagatccgcgatatcaatcacctcttccccggtcagtcccagcgttttacgcgttacgccctgtggaaactccagcggcaggatccccatcccaatcaggcttgagcgatggatacgttcgaacgactcggcgatcaccacgcgaatacctaacagccgcggaccttttgccgcccagtcacggctcgatcccgacccatactctttcccggcaattaccgccagcggcgttttttcctgctggtagagcatcgcggcatcataaatcgacatcgcttccgtacccggcaaatgccgcgtcatcccaccttcgacgccgggcagcatttcgttgcgaatacgaatattggcgaacgtaccgcgcatcatcacttcatggttgccgcgccgtgatccataggagttaaaatccttccgctcaacgccgtggttttgcagatagcgtccggcgggactgtccggcttgatactgccggccggggaaatatggtcggtcgtcaccgaatcgcccagcatcgccaggatacgcgcgccgtggatatctttgacgggtgcaggctgggcctgcatttcatcaaagaaaggcgacaggcggatataggttgaatccgactgccagccgtaggtatcggacgattcaacctgaatcgatttccattcttccgtgccctcaaacacttccgcatactctttacggaacatatccgatgataccagttcaacggcgcgggcaatttcctgcgccgaaggccagatatccttcaggtataccggatcgcctttacgatcgtaccccagcgggtctgtcgcgaggttaatattcatgtttccggccagcgcatacgcgaccaccagcggcggcgacaccagccagttcgttttcaccagcggatggatacgcccttcaaaatttcggttaccggaaagcacggcccctaccgtcagatcgccttttttaatcgcggtctcaataggctccggcaacggaccggagttcccgatacaggtcgtacagccatagccgaccaggttaaaaccgagctcatccagataaggcgtaagtttggcctgcgccagatagtcagataccacttttgaccccggcgccagagaagccttgacccacggttgacgcttcaaccccagcgttactgcctttttcgccagtaatcccgccgccatcagcacgctgggattcgaggtattcgtacaggaggtgatggcggcaatgacgacagcgccatccggaagctgatatggctgtccgttcatcgtatagtcaaccggctggcgatctctttgcgcggtattcagctccagctcggcgctggcggcaaaggctttcggcacatcgcctaacgccacgcgatcctgcgggcgtttcggcccggccaggctggcctcgacatcgcccatatccagttccagcgtactggtaaataccggttcgtcaccgggattacgccacattccctgcgccttcgcgtaggtttcaaccagctcgatcagatcgtcgctacgtccgcttaatcgcatatattccaaggtgatggcgtcaatggggaagaaaccacaggtggcgccatattccggcgacatattagcgatagtcgcgcgatccgccaacggcagcgaatccagaccgtcaccataaaattcaacaaatttacccacgacgccatgcttacgcagcatttgcgtgacggttagcaccaggtcagtggcagtgatcccctcccgaagtttaccggttaacttaaagccgacgacatccgggataagcatcgacacgggctgaccaagcatcgccgcttccgcttcaataccacccacgccccaccccaatacgcccagaccattaatcatggtcgtatgggagtcagtccccaccagcgagtccgggtaagcaatccactccccgtcctgtaattcgctccagatggctttacccaggtattccaggttaacctgatggcaaatgccggtgccgggcggcaccacgctgaaacggctgaatgcctgctttccccatttcaggaacatataacgctcatggttacgttccatttccagccgcacgttttcttcaaacgcatcatcatcgccgaaatgatcgaccgtcacagagtggtcaataaccagatcaaccggcgataacgggttcactttcgacgtatcgccgccgaggcgtttaacggcttcacgcatcgccgccaggtcgacaacggcaggcacgccggtaaagtcctgcatcaggacacgggcgggccgccaagcaatttcacgatcggcatgggcatttttaagccaaccggccagcgcctgaatatcttcatcagtcacagattcgccgtcctgccagcgcaacaggttttccagtaacactttaagtgatttgggcaaacgggcgatatcgcccagggatttggcagccagcggcagactgtagtaatgatacgttttatctttggcctgcaatgtatccttactggcttctcgtagggttgacgacatagctcctcctttaatgacagggttgcgttaccctgattctccacagggttgtattaaagataacacaaacaaaatgtaacgttttgataacaacccaaattgctaaaagaggagaaacctaacaggcgaggaacgaagatgaaaaagcccgataaataacgcattatcgggctttgacgagattagacggcaatccagattaactcggcccagaacagtagcgataatataaacgcgccagtccatgaccaatactttatatttgacgttaacataggcaacaccaactgtgtttaatcaatactgagaagcgctcagcacacggttgctgcggtgtaataagacagcgttaataaaacagtaacgccaataaaaagacgaatattatttttgtgacacctcgtcagcaaaagcatcaataaatgcccgctgctgcggtgtgagcgtccagtgttgcggaacagaccgaaaaacggtcgtatccggggtgttatcatcgtcaccagattgaatcgggggcgcgaccacgcgctcgcgttccgacgtaatgctcacttagccccaccaatgccagataacaagcgctaccactacccagaacaacgcagaacccacaaaaaccgccagccatgctttacgtttgagctcagggtcgcggcgcggttcctggttttcagaaggcattactaacctcatgctatcggtatcacttatcatttcagcaccaaacaatcggtacaattaatcatcagatgagacaaatcctaaataaactttagtcaaaaatccagtcaatttacgaatcgttgccagtgaataaatcaatcttttgactcaagataactatttggaaaaagaaactggcgggacgggtaattcaacactattttgctgatcattacccgtaatacttcgagggatattgcaaaaggcggctttgtctgccatgccactacgacacaaacccacggtgatattacttttcaggcagctttatatcctgaaacatcgcttcaatttcttcattagaacgcaacgccaccgccgtatccaccacatcacgcgtcagatgtggcgcaaaacgctggataaaatcatacatatagctgcgtaaaaaagtactacggcgaaaaccaatttttgtggtgctgtggctaaaaatatcgtgcgcgtcaatccgcactaaatcaggatcggtaagcggatcgaccgccatgctggcaatgacgccaacgcccagccccaacctgacatacgttttaatcacatccgcatcggttgcagtaaagacgatccgcggcgttaaccctgcgcgattaaaagcggtatccagttcggaacgcccggtaaagccgaaggtatacgtcaccagcggatactgcgccagcgcttcgatcgttatggaagacgttgccgccaatggatgatccggcgtcaccactatcgaacggttccagtgatagcatggcaacatcaccagatcgtcatataaatgcagcgcttccgtggcaatcgcgaaatcggcgttccctttcgataccgcttccgcaatctgcgttggcgacccctggtgcatatgcagcgaaacgcgcgggtaacgctcgatgaagcctttaatcacgcctggcaatgcgtaacgcgcctgagtatgggtagtggcaatatagagcgagcctttatccggccaggtgtgctcgccggcgaccgacttaatggcatcgactttggaaagcacctcacgcgcaatacgaataatctcctgacctgcgggcgtcacctgagtcagatgcttaccactgcgggcgaaaatctggatgccaagctcatcttccagcatcctaacctgcttgctgatccccggctgggaagtatacaacccctcagcggtagaggagacgttaaggttatgattaaccacttcaacaatgtaacgaagctgctgcaatttcataatacatcatccagattagcgccatcaggccatcgtttatctgcagacatcattgggctgctaatacgatttaataataaaaaagatgttaactataaccactatatcatttatatctgaactgtatagccagcgcgataaaataataagcccgctatacccaaaataattcgagtgattaaaggcaacaagcgagtgagttccctggagcatagataaccaggggactggggtgagcgacaaatcagccgggagcagatttgaacgtcgcgtgcgacggcccgtcagggcgaggcccatagatgggccgagtaatccgtagccaacacataagccacttgaaatatgaaggggatataaaaaagggccgcttacgcggcccgcttgactacagtggcgacaggccggggttatttcttaccttcaacccacttgccgtcgacgaagaacgctgaccatcccgtcgccttcccgtctttttccgccgcaacgtactgctgttttgttttgcggctaaagcgaacaacggttttattgccttctggatcctgctgcggcgcatccgccagataacgcagtttttccggcaggcgatcgcggaaccggtaaagctcctcgactaatggcgcgcgcgtttcacgtgatttcgggaacgtattggccgccaggaatatccctgcggcgccatcgcgcagcacaaagtacgcgtccgatttttcacacggcagttccggcaatggaacaggatcttccttcggcggcgcaacttcgccgttacgcaagatcttacgggtatttttacattcgtcgttagtacaggccatgtacttaccaaaacgccccattttcaggtgcatttcggaaccacatttctcacactcaacgatcgggccgtcataccctttgatgcggaactcgccttcttcaatctcgtagccgtcacaggtcgggttattaccacacacatgcaatttacgcttcggatcgatcagatagctgtccatcgccgtaccgcacttctgacagcgacgtttggcgcgcagggcgttggtttcggcgtcgtcgccttccagcacgttcagaacttcattttccggcaccaggttaatggtcgttttacaacgctctttcggcgaaagcgcataacctgaacaaccaaggaaaacccccgtactggcagtacgaattcccattttacggccacaggttggacagtcgatgctggtcagcaccatctggttaggacgcatccccccttcttccggatctttctcggctttatcgagctgctgagtaaaatcgctgaagaagttatccagcaccgctttccactcggcctggtgattcgcaacctgatccagactatcttccatctgcgcggtaaaatcgtagttcatcaattcgcggaagttttcttccagccggtcggtgacgatttcacccattttttccgcatagaagcgacggttttcaacgcgaacatagccgcgatcctgaatggtcgagataatcgacgcataggtagacggacgaccaataccgcgcttctcaagctctttaaccagagaagcctcgctgaaacgggctggcggtttagtaaagtgctgagcaggcgtcaattcaagtagcgtcagcgcatcgcccttattcacgacaggcaatgtgcgatcttcatcgcctttacgcagcgccggcatcacttttgtccagccgtcaaagcgcaaaatacgcccacgcgctttcagacggaattcgcctgcgccaacggtaagcgtagtggagtcatattgtgctggcgtcatctgacaggcgacaaactgacgccaaattagctgatacaacttctgcgcgtcagcctccatgtctttcagcgactccgccatgacagcaacgtcggaaggacggatcgcttcgtgcgcttcctgagagttttctttgctggcgtattggttcgggttatccggcaggtatttcttgccgaaattatcgccaatatagccgcgcaccatgttgaccgcatcctgactcaggttggtggagtcggtacgcatataggtgatgtagcccgcctcatacagacgctgcgccatcatcatggttttcttcacgccaaagcccagccgggtgctggccgcctgttgtagcgtggaggtgataaacggcgcgccaggtttgctgctggtcggtttgtcttcacgctccagtacgctatagcgcgctttttccaacaagctgacggcggcaagcgtctgctcgcgatttaccggccggaatggcttgtcgttctgatgcgtgacctgtagcggtagtgcctcgccagacggcgtcgtcgtattagcgtcaatctcccagaactcttccggaacaaacgctttaatctcgcgctcgcgctcaacgaccagacggaccgcgacagactgaacgcgacctgccgacaaaccacgggcgatctttttccacagcagcggcgagaccatatagcctaccacgcggtccataaagcggcgcgcttgctgggcgttgaccctgttaatgttcagctcgcccggctgttcaaacgcctggcgaatggcatttttggttatttcgttaaagactacgcgactgtagcgcgcgtcatcgccgccgatcacttcccgcaggtgccatgcaatggcttccccttcgcggtcaaggtcggttgcgagatagatgtggtcggctttttccgccaactgtttcagttcagagacgaccttctctttaccgggcagcacttcatagtgcgcatcccagttgtgccacgggtcaacccccatacggttgacgagagcgccacgttcatcctttttgggctttttagccgttttggtggaggtagagtcggcgctctttttagctgctgagccactggtcggcaaatcacggatatgacccacgctggatttcaccacgtagtcattacccagatacttgttgatcgttttggcttttgccggggactcaacgatgacaagagctttacccatattcacctttacctaagttgattcttccaggaatgcgtcgcacgttgattcaccttccactggcgacgagacaacgatatatggtctctgcgtctgcggatatcaaccccttgtactggctttgtgtacgaaatgtaaccctcaggtgactgagttaacaggcttttttgcacacacgcgctatagcacgacggaattttggtcgaatgtcaagcaattctgttgccagattgacgaaagcgtcacactgtacctgataaaattcgatacgcaactttattagcatgcaaaaacaaatcttgccagtgaacgcaacatgacaaatccatcaatttcctgtgagaatatttgcccatcagaagtgctcagcgtagactaatctccttgtttaaggagtaaaaaatgcataaagagacgcaacctatcgatcgcgaaacactgttgcttgaagccaacaaaattattcgggaacatgaagacacgatggcaggtattgtcgccaccggcgtaacgcagagaaatggcgtgctggttttcagcggcgattactttttagacgagcaagggttaccgacccctaaaagcaccgcggtgtttaacatgtttaaacacctggcgcatgtgctgtctgagaagtatcacctggttgattaatccatgccggatggcgctgaatgccatccggcaatagcggtttacatcaacggcttttgtccacgctgccaccagcgcagcagcagccgatccgcgctttccgccgcgctgccggtaacacgatcgatcagttttttacgctgcatatagcgcacattcagcacctcgcgcccttccatcaggccgaggataacctcatcgctggtgttaatctcatcaaccagtcccttctccagcgcctgctgaccgtaccagtgttcgcccgtggcgacctgttcaatgtccagagccggacgcatccgctgcacaaactctttgaacagatggtgcgtttcgttgagatcttcacgaaacttctgccgcccttcttccgtattctcgcctaacaaagtcagggtacgtttgtactgccctgcggtatgcagttcaatatcaatgtctttacttttgagaaagcggttaaagttcgggatttgcgcgacaacaccaattgaccccacaatagcgaacggcgccgcgataattttttccgccacgcaggccatcatgtagcctccgcttgccgcgactttatccaccgtcacggtcagcggaatatttttatcgcgcaggcgctgcaattgcgatgccgccaggccatagccgtgcacaacgccaccggggctttccagacgcacaaccgcccgatcgccgggtttcgccactgccagcaccgccgtgacctcttcgcgtaacgcattaacttcgtgagcgtccatactgcctttgaaatctatcacccatacgcgcggtttgtccgatgtcgcaatgccccccagcttcgctttcgctttggcggctttcgcctcctgcttatgcttttttttctgcgctttatgccacagtttttgctgatggccatccatcaacgccgcagcaaggtcatccttcatctcctgatactgctcactcaaattggtcacgcgcagctcgccgcgctgacgtttgcgttgcgtagcattcacgatcagcagcacaatgacggcaatggccaccacaacggtgacgatttttgccaaaaataagccatattcagacaacaattccacgactcccaccttgattaaataacgcgacttgcgctcagtgtacaacaggcatcgaagtcagtctctcttcatccgtatgcctgttgaggaagaaaaagtatgacaagacgttcattttacggcgttatcgcccctgtctgattgaaaaaaaaggcgctttcaggcataaacccgaaaagttaacgcgaagataagacaacctggcaggacggtgcaccacaccgttgaggagtagccatgcattaccaaccgaaacaagatctattgcaaaaccgcattattctggtcactggtgccagcgatggcattgggcgggaagccgcgctcacgtatgcgcgttacggcgcaacggtgattctgctgggacgcaacgaagagaaactgcgtcgggtcgcgcagcacattgctgacgagcaacatgttcaaccacagtggtttacgctcgatctgctgacctgcaccgctgaagagtgccggcaagtggccgaccgcatcgccgcgcactatccccgcctggatggcgtcctgcacaatgccgggttactgggggaaatcggcccaatgagcgaacaagatccgcagatctggcaggatgtcatgcaggtaaacgttaacgccacctttatgctcacccaggcgctgttaccgttattattgaagtccgatgccggctcgctggtctttacgtcatcaagcgttggccgtcagggacgcgccaactggggcgcctatgccacctcgaagtttgctactgaaggaatgatgcaggtgctggcggacgaataccagaaccgttctctgcgtgttaactgcattaacccgggcggcacgcgcaccagtatgcgcgccagcgcctttccgacggaagatccacagaaattaaaaacgcctgccgatattatgccgctttacctgtggcttatgggcgacgacagtcgccgtaaaaccggtatgacctttgacgcccaaccgggccgtaaaccaggaatcgcccaatgagtgatgaacgttatcagcagcgccagcagaaggtaaaagatcgggttgacgcccgtgtcgcccaggcacaggaagagcgcggtattattatcgtgtttactggcaatggtaagggcaaaaccacggcggctttcggaactgccgcccgcgccgtaggacacggtaaaaacgtaggcgtggtgcaatttattaaaggcacctggcccaacggcgagcgtaatctgctggaaccgcatggcgtcgaatttcaggtgatggcaacgggatttacctgggagacgcaaaatcgcgaggcagacaccgcagcatgtatggccgtttggcagcatgggaaacgaatgctggccgatccgctgcttgatatggtagtgctggatgagctgacctatatggtggcgtatgactatttaccgctggaagaggtcataagcgcgctaaacgcgcgccctggtcaccagacggtgattattacaggtcgcggctgtcaccgggatattcttgattttgcggataccgtcagcgaactgcgtccggttaaacatgctttcgacgcgggcgtaaaagcccagatgggaattgattattaaccgtaggccggattaaggcgtttgcgccgccatccggcacaaaccctcttgtctgatgactctcggcctataaaccacggtagagattacccgttgttattacgcccaccggagcggcgtccgccagctatctggctgtggcgttttaccgcccgacggatctggttcgctttcatacgacgacggtctttttcgacggcaaccttcgacgaggtttccggcgggagctctaccagaccacgcagatagttcgtttgcgcgaggtcgagctcagtccagccgccgcgcggcaggcctttcggcagcgggatatcgccgtaacgaacgcggatcagacggctgacctgaacgcctaccgcttcccacagtcggcgaacttcgcggttgcgcccttccgtcagcgtcacgttataccactggttaatgccttcgccgccgctgaatttaatggtcttaaatgccgccggaccatcttccaactgtacgccacggcttaaatcacgcagtttcgattcatccacctgaccgaacacgcgcacggcatattcacgttcaacttcgcgactaggatgcatcaggcggttcgccagttcaccgtcggtggtaaacaacaatagcccgcaggtgttgacatccagacgtcctaccgcaatccaccgcgcgccgcgcagtttcggtaagcgatcaaaaacggttggccgcccttcagggtcattgcgggtacacagttcaccttctggtttgtaataggccagaacgcggcaaatttgttccgccgactctttcaccgaaatcaggtgaccgtcgatacggattttcaaaccgggagtgacttcaacacgatcgccaagcgtggcgattttaccgtcaacgctgacacgtcccgcttcaataatggattcgatttcacggcgagagccgtggccagcgcgcgccagcactttttgtaacttttcgctcatagagcttccttcaggtgtcgccttcacaggcgtcgaacaggagaatgaacggcgcgttgccgcgccattttaaggccgcgtagtatacaggcttacgcccttataagaaaggtgtaacgtcgccgacgccttcgcgcagcaccaccggggagtcattggtcaaatcgattaccgtggtaggctgttgaccgaggtaaccaccgtggatgatcagatccacctgcttctccagccgatctttaatctcctccgggtccgactcggtaaaatcgctgccaggcagcatcaacgacgtcgagagcatcggttcgcccagcgtatccaataacgccagcgcaatcgggtttgacggtacgcgcaggccgatagttttacgcttttcctgcaacagacggcgcggcacctcttttgtccccttcaggataaaggtgtaattacccggcgtattgtttttcatcagacgaaatgccacgttgtcgacgtaggagtaggtcgacaactcggacaaatcgcggcacatcagcgtgaagttgtggccgtccggcagatgacggatgcggcaaatgcgctccattgcgcctttgtcttcaattttacaaccaagggcatagccggaatcggttggataaacaataacaccgcctttacgcacaatgtcgacggcctgattaatcagccgttgctgtgggttatccggatggatataaaaaaactggctcatacttccctcactgtgatatttgcggctgttcccatgcctgccatacgccttcaacgccagcgggcagccagagtttacgccccaactcaatccacgggcagggctgatggaaatcagatccaagcgatgcccataaatgatgctgacgcgcaagcgtcgccagttgggtgcgttcattgggtgattgttggcactgcgccacttccatcgcgtcgccgtgatggtcggcaaaatgcgccactaatcttttcagccacttagcgctaaggtcgtagcgtcccgggtgggccaacaccgccttaccgccagaatgatgaatgacatcaatagcttgttctattgtacaccactgcggcggaacgtaaccggttttcccacgcgcgagatattttttaaaaacctccgccatggtcgtggctttgccgcactccaccagaaagcgggcgaagtggccgcgcgtcaccgcgccgccattggccagtctcaatgccccttcccacgcgccgggaatatgggctttttccagacgctccgcaatgagccgaccacgcgcctgacgccgatgtgtctgctgcgctagaaaatcgcgcattgccgggtgcgcaatatcaatattcagacccacaatgtgaatctcatgattctcccagaccgttgaaatctccacgccgggaatcagattcagggccagcccgcaacgtgaaatttcttctcttgccgcaggaatcgcagctgtggtgtcatgatcggtaatcgccagcgtgccgactcgcatctctaccgcacggtgtactaatgtttctggcgtcaacagtccatcggacgccgtggtatgactgtgcagatcgtaaatcactgcgtaattcgtgtcgctcaaggcggctcccatagagataaaggtatgtcatgtacatcataacggttccggcaaatatactgaaataggtgttgacattattccattgaaccagttaactagtacgaaagttcacatgaagagggtatctaaaatggcagcgacatttgcattacacggttggtggcgcacttcctgatagcgggcggtgtatgaacagctgtaatcagccaaacgatacccggcccgcctgttaagcgggcttttttttgaacaaaataatgagaataaccatgcaaacaccaaaacccacgctcgaactattgacctgcgatgccgcctaccgggaaaacccaacggcgctttttcaccaggtctgcggcgatcgcccggcaacgctgctgctggaatccgcggatatcgacagtaaagacgatttaaaaagcctgctgctggtagatagcgcgctgcgcattaccgctttaggtgacactgtcactattcaggcgttatctgataatggcgcctcgttattgccgctactggataccgccctgcccgctggcgtggagaacgaagtcctgcctgccggtcgcattctacgctttccgcccgtcagcccattattagatgaagacgcccgtttatgctctctgtcggtatttgatgcgttccgcctgttacagggagtggtgaacataccgacgcaagagcgggaggctatgtttttcggcggtctgtttgcctacgacctggtcgctggctttgaagcgctgccacaccttgaggctggcaataactgcccggactactgcttttatttagcggaaacgctgatggtgatagatcatcagaaaaaaagcacccgtattcaggccagtctgttcaccgccagcgacctggaaaaacagcgcctcaacgcccgcctggcgtaccttagccaacagttaacccagcctgcgccgccgttgccggtgacgccggtgccggacatgcgctgtgaatgcaatcagagcgatgacgcgttcggcgcggtggtacgccagttgcaaaaagccatccgcgcgggcgagatatttcaggtggtgccgtcgcgccgcttttcactgccctgcccgtcgccgttggctgcctactacgtgctgaaaaagagcaaccccagcccgtatatgttctttatgcaggataatgatttcacgcttttcggcgcgtcgccggaaagctcgctgaaatatgacgccgccagccgtcagattgagatttaccccatcgcgggtacccgtccacgcggtcgccgcgccgatggtacgctggacagagatctcgacagccgtattgagctggacatgcgtaccgaccagaaagagctttccgaacatctgatgctggtcgatctggcgcgcaatgacctggcgcgcatctgtacgccgggcagtcgctacgttgccgatctgaccaaagttgaccgctattcgtacgtgatgcatctggtttcccgggtagtgggcgaactgcgtcacgatctcgacgcgctgcacgcctatcgcgcctgcatgaacatgggcaccctgagcggcgcgccgaaagtacgcgccatgcagttgattgccgatgcggaaggacagcgccgcggcagctatggcggcgcggtcggttacttcaccgcccacggcgatctggacacctgtattgttatccgctccgcgctggtggagaacggtatcgccaccgtacaggcgggcgccggaatcgtgctggactctgttccgcagtctgaagccgatgaaacccgtaataaagcgcgcgccgtattgcgtgctatcgccaccgcgcatcatgcacaggagaccttctgatggctgatattctgctgctcgataacatcgactcgtttacctggaacctggcagatcagctacggaccaacggtcataacgtggtgatttaccgtaaccatattccggcgcagacgcttatcgatcgcctggcgacaatgaaaaatccggtgctaatgctctcccccggtccgggcattcccagcgaggcaggctgtatgccggagctgctgacccgactacgcggcaagttaccgatcatcggcatttgtctggggcatcaggcgattgtcgaagcttacggcggttatgtcggtcaggcgggagaaatcctgcatggcaaagcctccagcattgaacatgacggtcaggcgatgttcgccggtctggcgaatccgctaccggtcgcgcgttatcattcgctggtcggcagtaatgttcctgccgggctaaccattaacgcccatttcaacggcatggtgatggcggtacgtcatgatgcggatcgcgtttgcggttttcaatttcatcctgagtccatcctgacgacacagggcgcgcgtctactggagcaaacattagcctgggcgcagcaaaagctggaaccgaccaacaccctacagccaattctggagaaactctatcaggcgcaaactctgacgcaacaagagagccatcagttgttttcggcggtcgtccgcggcgaacttaagcctgaacagctcgccgccgcgctggtgagcatgaaaattcgcggcgagcatcccaatgaaattgccggcgccgccactgcgttgctggaaaatgccgccccgttcccgcgcccggactatctgtttgcggatatcgttggtaccggcggcgatggcagtaacagtatcaatatctctaccgccagcgcctttgtcgcggcggcctgtggactgaaagtggcgaaacacggcaaccgcagcgtatccagcaaatcggggtcatccgatctgttggcggcgttcggtattaatctggatatgaacgccgataaatcacgtcaggcgttagatgaactgggcgtctgtttcctgttcgcgccgaaatatcacaccggattccgtcacgcgatgccggttcgccaacagttaaaaacgcgaaccctgttcaacgtactcggcccgctgatcaacccagcgcatccgccgctggcattgattggcgtctatagcccggaactggtgctgccgattgcggaaaccttacgggtactgggctatcagcgcgcggcggtggtacatagcggcggcatggatgaggtttcgctccatgcgccgacgattgtcgcggagctgcatgacggcgaaattaaaagctatcaacttacggcggaggattttggcctgacgccttaccatcaggatcagttggctggcggcacgccggaagaaaaccgtgacattctgacgcggttattacaaggtaaaggcgatgccgcgcatgaggccgccgtcgccgccaacgtggcgatgctgatgcgtctgcatggtcaggaagatctcaaggccaacgcgcaaaccgtgcttgatgttctgcgcaacggcaccgcatatgacagagtcaccgcactggcggcaagagggtaaataatgcaaaccgttttagcgaaaatcgtcgcagacaaggcgatttgggtagaagcccgcaaacagcaacagccgctggccagttttcaaaatgagatccagccaagtacacgccatttttatgatgcgctccagggcgcgcgtaccgcctttattctggagtgtaagaaagcatcgccatcaaaaggcgtgattcgcgacgatttcgatccggcgcgtattgccagtatttatcaacattacgcctcggcgatctcggtgctcaccgacgaaaaatattttcaggggagcttcgattttctgccggtcgttagccaaagcgcgccgcagccgattctgtgtaaggattttattatcgatccctatcagatctaccttgcccgttactatcaggccgatgcctgtttactgatgctctcggttctggatgacgaacagtatcgccaactctccgccgtcgcgcacagtctgaaaatgggcgtgctcacggagatcagtaatgacgaagaacgggagcgcgcgatagcgttaggcgcaaaagtggtaggtatcaacaatcgcgatctgcgcgatctgtcgattgatttgaatcgcacccgccagctggcgccaaaactgggccacggcgtgactgtcatcagcgagtccgggattaacacctatggtcaggtacgcgaactgagccacttcgccaacggttttttaattggctccgcgttaatggcgcatgacgatcttaacgccgccgtccgtcgcgtgctgcttggcgaaaataaagtctgcggcctgacccgcgcccaggacgctaaagcggcctgtgacgctggcgcaatatatggcgggttgatttttgtgccctcatctccgcgcgcggttagcgttgagcaggcgcgagaagtgataagcggcgcgccattgcagtatgtcggcgttttcaagaacgctgatatcgccgatgtttgccagaaagccgccgtcctgtcgctttctgccgtacagctacatggcagcgaagaccaggcgtatgtcaacgcgctgcgcgaggcgttgccgcgcaatgtgcaaatctggaaggcgctgagcgttagcaatgcccttcccgcacgcgattatcaccatgtcgataaatacattttcgacaatgggcaaggcggcagcgggcagcgcttcgactggtcactgctacaggggcaaccgctggatgatgtgttactggcgggcgggctggcggccgataactgcgtccaggcggcgcaagtcggctgtgccggtctcgattttaattcaggtgtggagtcacagccgggcatcaaagatgctcgtcttctggcctcggtttttcagacactgcgcgcatattaaggaaaaaacatgacaacacttctcaacccctactttggtgaattcggcggcatgtatgtgccgcagatcctgatgcctgcgctgaaccagcttgaagaggccttcgtcagcgcgcaaaaagatcctgaatttcaggcgcaattcgccgatctgctaaaaaactacgcgggacgccccaccgcgctgacgaaatgccagaacattaccgccggtacgcgtaccacgttgtatttaaagcgcgaagatttactgcacggcggcgcacacaaaaccaatcaggtactgggtcaggcgctgctggccaaacggatgggtaaaagcgagattatcgctgaaaccggcgccggtcagcacggcgtcgcctctgcgctcgccagcgccctgctgggtctgaaatgccgtatctatatgggtgccaaagacgttgagcgccagtcgccgaacgtcttccgtatgcgtctgatgggcgctgaggtcatcccggttcatagcggctccgctacgctaaaagatgcctgtaacgaggcgctgcgcgactggtccggtagttacgaaaccgcgcactatatgctcggcacggcggcaggaccgcatccctatcctaccatcgttcgcgagttccaacgcatgattggcgaagagacgaaagcgcaaatcctcgacaaagagggccgtctgccagatgccgttatcgcttgcgtcggtggcggctcaaacgctatcgggatgtttgcggattttattaatgataccagcgtcgggctaataggcgttgaacctggcggtcacggtattgaaaccggcgagcatggtgcgccgcttaaacatggtcgcgttggcatctatttcgggatgaaagcgccgatgatgcaaacagcagacgggcaaattgaagagtcctattccatttccgccggactcgatttcccgtccgttgggccgcaacatgcgtacctgaacagcatcggacgcgcggattatgtctccattaccgatgatgaggcgctggaagccttcaaaacgttgtgccgccatgagggaattatcccggcgctggagtcctcccacgcgttggcgcacgctctgaaaatgatgcgcgagcagccggaaaaagagcaactgctggtggtcaatctctctggccgcggagataaagacatctttaccgtacacgatatcctgaaagcgcgaggggaaatctgatggaacgctacgaaaatttatttgcccaactcaacgatcgccgggaaggcgcttttgtccccttcgtgaccctgggcgaccctggcattgaacagtcactgaaaattattgacacactgattgacgctggcgccgacgctctggagctgggggttcccttctccgatcctctggccgatggccctaccatccagaatgcgaacttacgcgccttcgccgctggcgtcacgccagctcagtgttttgaaatgctggcgctgattcgtgaaaaacacccgaccattccgattggcctgctaatgtacgcgaatctggtgttcaataacggcatagatgcgttctatgcccgttgtgaacaggttggcgtagattccgtgctggtcgcagatgtcccggttgaagaatcggcccccttccgccaggcggcgttacggcataatatcgcgccgatcttcatctgcccgccaaatgcggatgacgatcttctgcgccaggtcgcatcttacggccgcggttatacctacctgctttcgcgttcgggcgtcaccggcgcggaaaaccgtggcgcattgccgttgcatcatctcattgagaagcttaaagagtaccacgccgcgcctgcgttacagggcttcggtatctcctcgccggaacaggtgtctgcggccgtgcgtgccggggcggctggcgctatctccggctcagccattgtcaagattatcgagaaaaacctcgcgtctcccgaacagatgttggcggagctcaggtcctttgtctcagcgatgaaagccgccagccgcgcataacgggttaagccgtcagcataacgctggcggcttaatgagaggttggcgccaaaccagaatcacgattcaggcgtacatcatcaatctttttggtgttattccccgtccagctttcaaaaagtctgaagtcaatttttgctaagaaaactcctaatcacgccgaaaaatttagcgttttcacgtcaatttcccccgcctttatgtaaagaaatgtcaacaaacaatgcattaacgtttccagggccgcagatagtgactcttgttattaataacaatgcaaagcattttctgttaaatcgcttattctaaaagaaaatatagaatatattatctctaaaccattttttgtgcattatttacgcggtaaatcacaactatttccgtcaatttgactaatcggtttaaccaactaattttaatagggtgtcgacacggttaaaaccgattttttcagcaagcaacgagacaggagaaataatatggccgaacatcgtggtggttcaggaaatttcgccgagaatcgtgaaaaagcatctgaagcgggccgcaaaggcggtcagcatagcggcgggaatttcaaaaacgatccgcaacgagcttctgaagccggtaaaaaaggtggtcagaatagtcacggcggacgtaaatccgataattcctgatttactgtaatgtaaatataacacatgcttttatcaagcaatctgcgagtcttctggctcgcagtattttgcccaggagaattagatttatgaatatcaaaaccgttgaagacctttttatccatctactttcagatacctatagtgcagaaaaacaattaaccaaggctcttcctaaacttgccagagccacgtccaatgaaaaattaagccaggcctttcaatctcatcttgaagaaacccagggtcagattgaacgtattgatcagatcgtcgaatctgaatctggcattaaactgaaaagaatgaaatgcgtcgctatggaagggctgattgaagaagccaatgaagtcatcgaaagtacggagaaaaacgaagtacgcgatgcagcgcttatcgccgcggcgcaaaaagtcgagcattacgaaatcgccagctacggcacgctagccaccctggccgagcagctcggctatagcaaagcattaaaactgctcaaagaaaccctcgacgaggaaaaacaaactgatttaaaacttaccgatttagcagtcagcaatgttaataaaagtgctgaacgcaaatcgaaataatatttttaattatcagcttgcatgattccgattttattatcggagcagattatcacgcattgaggaatgtaaaatgaattatactgaacattatcatgactggcttcgtgacgcccatgccatggaaaaacaggcagaatcgatgcttgaatctatggccagccgtattgaaaattatcctgatataaaagccagaattgaacaacatattagtgaaaccaaacatcaaattaccatgctcgaggaagtgttggaccgtaatggcatttcccgttcggtgttgaaagactccatgagtaaaatggcagcaatggggcaatctatcggtggcatgttcccttccgatgaaattgtcaaaggctcaattagcggttatgttttcgagcagttcgaaattgcttgttatacctccctgctggcggcggcaaaaaaagctggcgacactgcctcaattccaacgattgaagccattctgaaagaagaaatgcaaatggctgactggcttatcaaacatattccgcagacaacggaacaatttttactgcgatctgaagcagatggcgttgaagccaaaaaataaataataagcaggaggcaatatgtttcgacacgtaaaacaacttcaatatactgtgcgagtgagcgaacctaatcctggattagcgaacctgctgctggaacagtttggcggcccgcagggcgaactggcggccgcctgccgctacttcacgcaaggtttaagcgatgatgatgccggtcgtagagagatgttaatggacatcgccaccgaggagctgagtcatctggaaattatcggctcactggtaggaatgcttaataaaggcgctaaaggcgagctggcggaaggcaccgaaagcgaagcggaactttatcgctcgctgacgcagaatggtaatgacagccatatcacctctctgctgtatggcggcggccctgcgttgacaaactccggcggcgtaccgtggaccgcggcttatattgatactatcggcgaagtcacagccgatctacgctcaaacatcgcggcagaggcgcgagcgaagattatttatgaacgcctgattaacctgaccgacgatcctggcgtaaaagacacgctcagtttcttaatgacccgtgaagtcgcgcaccagctctcttttgaaaaggcgctgtattcgattcgtaacaacttcccgccgggtaaattaccgccggtagaacagtataccgacgtgtactacaacatatcgcaaggcgacgatccgcgaggtagctggaatagcgatgagaacttcaactatgtcgcagaaccgatgcctgctgttgatggcggcgatggcctggcgacagtgaaattgccgcgcgagcagatggcgctgctcaaagcgatggcagaaagaacgaaatcggaccccaccgttgatcctctcactggcgcagaactaggctgcggcgaaccgaaagaagacaagtgagttccgacaagtaaaatccgtgtgtcatgtccttttttgaccccgcctggcggggtcttttttcgtcacaacatcacgcgattagaaacgatagcctgccgagaacataaatacccatgggtccagacgcacgctgtcatgctgctgcacgccgcccattttataattggctgtagtatcaatatccatgtaccagacagaggcgccaattaaccagtcgcggttaatcaggtaatctaccccaacttgccctgccgcgccccaggaatccttaaagctcagatcggacagcccggtctttttaccattatcgttaaagtcgttatcgaagaaggtggtgtagttcacccccacgccgacataaggacgcactttgctgctggaatcgccgaagtaccactgcgccattaacgttggcggtaacaggtggaccgtggcgatatcacccgtcgcgcccgtacccaccttatggcggaacggcgtggccgccagcaattcaaccccgatattgtccgtcgccatgtaagtgaatgtcaggccgagttgcgtgttattactcacatcaaacccgtttaaatgccccagcgtaccacccgccccttctgtaggtctgacggttgccggacctgcacgcataaagaattctccggcttcgtgcgcgaacgcgctgcctgagagaagagttgttaacgccagtgccgccactgtaaattttttcatacccgctccatcgttatggttataaaagcgtgatgaatatacccacaatgaagtaataagtgatctaacacagatcacatttgttcttataatttaacatttattgatccagattaatttagaacttgtattgaaaatcctggttataggaattcagatcaattttgacatattcacgctatgcaaatatttgtctgctcctgttgccctggcgataaaggctggctaaggtaatcaatgtcccgcaatggcgcgtggcggtaagattcgcgaacactgcgggacagattaatttccgttgtaatctattgatacgtgagttttttgcaggtgaatcatgagcgttcttaacccatgcatgacatgcggtgcctgttgtgcctattttcgtgtctccttttattgggctgaaggcgacgatgccagcggacgcgttccggcgtcattaaccgagcctgttaccccttttttacgttgtatggccggtaccaaccaaaaacagccgcactgtaaagcgctaattggcacgccgggtgaaaacgtcagttgcgctatttatgaaaaccgcccttcaacctgtcgcgaattttcgatatcgggcgaaggaggcgaagtgaatgaggcgtgtaatcgcgcccgcgcgcgatacggattaccgccgctttacaaagatatgcttttccatacaactgctgatgctgccactgtagagttatccagggtacaattgcccgcaaattaacacctgcaaaactcaaggagagtgcatgtctatcacggcgaagtccgtttaccgtgacgccggaaattttttccgaaatcaatttattactatcttgctggtttcgttgctgtgcgcatttatcacggtggtcttaggtcatgccttttcacccagcgatgcgcaaatcgcgcaactcagtgaaggagaacatctggcaggcagcgctggcctgtttgagctggtacaaaatatgacgccggagcagcaacagatcctgttgcgcgcctctgccgcctcgacgttttccgggcttatcggcaacgctattctggccggcggtatcatcctgatgattcagttagtttcagcgggacatcgggttagcgcgctgcgcgctatcggcgccagcgcccctgcattgcctaaactgtttattcttatttttctgactaccctgttagtgcaaatcggtataatgctgattgtcgttccggggattattatggccattgtgctggcgcttgcgccagtgatgttggttgaagagaaaatgggcgtgtttgccgcaatgcgcagcagtatgcgtttagcctgggctaacatgaaactggtcgcgcctgcggtgataggctggttactggctaaaacattgctattgctgttcgcgcccagcttcgctgtactgaccccaaatgtaggcgctgtactggcgaatacgttgagcaatctgatttccgcagtattgcttatctacttattccgcctgtatatgttgattcgccaataatccgcaatgcgccgttacgcggcgcattcgacgctcgttgatgatggaatcgaagaatgaagcagtttctggattttttaccgctggttgtcttttttgcgttttataaactttatgacatctatgcggcgacctccgcactgattgtcgcaacggcaatcgtgctgatttatagctgggtgcgctatcggaaaatagagaagatggcgctgattacctttgttctggttgccgtcttcggcggtctgacgctcttcttccataacgatgaatttattaaatggaaggtgacggttatttatgcgctgttcgccggcgcgctgttaataagccagtgggtgatgaaaaaaccgttaatccaacgtatgttaggtaaagaactggcgttgccgcagcaggtctggtcaaagctgaacctggcgtgggcgctgttttttattgcgtgcggtctggctaacatttatatcgccttctggttgccgcaaaatatctgggttaactttaaggtcttcggactcacggcgctgacgctcatttttaccctgctgagcggcgtctatatctaccggcatctgccacaggaagataaatcataaccctcccgtgacttatcatcgccagactgcgaacgcctggcgatattttctccgcctttacgccctgcgctttcccgtcagtacctttattcccactattctccacacaatattcatagtagcatcgcggctgtaattttttctgatagtcggttttacaatgacaacaatggataatactcctcagggcgagctggttttacgtacattggccatgcctgccgataccaatgcgaacggcgatatttttggcggctggctgatgtcgcaaatggatattggcggcgcgatactggccaaagagatcgcgcacggtcgggttgtaaccgtacgcgtggaaggaatgacatttctgcgccccgtcgcggttggcgatgtcgtatgctgctacgcgcgctgcgttaaacgcggtacgacgtctattagcatcaatattgaagtctgggtgaaaaaagtcgcgtcagaaccgattggacagcgctacaaggccaccgaggcgctgtttatttatgttgccgtcgatccggacggtaaacctcgcccgctcccggttcagggttaagtatacccgcttacgccgccagcaggtgatggtatattcctactggcggcgccagagattactcaatctgcgccgcaccgttcagacggaagataatattgaccaccagcccggaacccggcttgcctgcttcatagcgccattttcgcatcgcattcttaacttcacgctcaaacatattggctggctgcgcggatagaatctgtacattttccactcgcccagcagcggtcacgtcaaacttcacctttacgcgaccttcaatacgtaacgcctgtgctcgcgccggatactgcggctggttacggctcagagctcgaggtccagtgggcacgctcaccgccggcttgctggtcgccgatgcggtgccgcttgttggccgcatcggggcgctattttcaaacggtgaggcaggacgcggtgcggctggtttgacttcgcgcttcggctgctcttcaacctttttcaccggttccggtttcggttttggcttgggttttggcttaggtttgggtttctcaatcaccacgggcgcttctttaggcggttcagggatcggctctggctccggttcgggttcaaccaccggctccggcggcggctgaaccgcctggggcggctccaggtcagcgggtgaaaccattgtcaccgtgataggctgcgctggcgcaggcaattcaataacctgatgtaccgaggtatagagcaaacctgccactacagcaccatgaatgcctacggaaaggagtgtcgaccagggaaagcgacgaggtaaatcaagggtcattgaagtcataatcgtttcagttgaaaaaccagagctgaattttaaatgcaaatagcaatcatattcaataaggcattgccgatagcggcatttaaaagatgatattgcacaaaaacaccacacaaaatgtgcatgtttaacaaagtcggtatctttacattgcagttaaatgccctttccaataacgtaatcagcaacttttaccgattaaggagctctacccgtgctgtatgttatttacgctcaggataatgccaactcgcttgaaaaacgcctctcggtacggcccgcgcatctggcgcgcctgcaacttctgcatgatgaagggcgattattaactgccgggccgatgcccgcagtggacagtaacgatcctggggtagccggatttaccgggtcaacggtgattgctgaatttgaatctttagaagcagcgcaatcctgggctgatgcggatccctacgtcgcagcgggcgtctatgcgcaggtttcggtcaaaccgtataagaagatcttttgaaaaggatggcctgttgggcaccgcatacggtgccctttctggctcacacaccgtgaatcgcaaagagtaatgaattacgctgacgattaaagatgcatttcctgatagtatggatacgcatattacggcgtgattgcccttcaagccaacgcgctttacggcggctcgcctgacgtagcattcgccagcgccccacttccgttctactacgcttcatgtttacgactctcactgtaacagaagcgccattataccccctcgccggatgcagaccagcgcttttcccgtgtttttatttgccatgtgaatcctgacgcgtaaactcttaacaacacgctttctaaaggatttttaaagttatgacaaccttctacaccgtggtgagttggctggtcattttgggatactgggttctcattgccggcgtcacattacgtattctaatgaaacggcgcgcagttccctccgcaatggcctggttgttaatcatctatatccttccgctggtcgggatcatcgcctatttgtccgtgggcgaattgcatttaggcaaacgtcgcgccgagcgtgcccgcgccatgtggccgtctaccgccaaatggttgaatgacctcaaagcctgcaaacacattttcgcgcaagaaaacagtagcgtcgcatcgtccttgtttaagctgtgcgaacgacgtcaggggattgcgggcgtcaaaggcaaccagttgcaattacttaccgactccgatgatgtcatgcaggcgcttattcgcgatatccaactggcgcggcataatatcgaaatggtgttttacatctggcagccaggcggcatggcggatcaggtcgctgaatcgctaatggccgccgcccgccgcggcatccattgccggcttatgctggattccgcgggtagcgtcgctttcttccgcagcccctgggcggccatgatgcgtaacgctggcattgaagtcgtagaggcgctgaaggtgaatctgatgcgcgtctttttacgccgtatggatcttcgccagcaccgtaaaatggtgatgattgacaattacatcgcctataccggcagtatgaatatggtggacccgcgttttttcaaacaggatgccggcgttggacaatgggtcgatttgatggcgcggatggagggtcccgtggcgacagcaatggggattgtttactcctgcgattgggaaatcgagacgggtaaacgcattctgcctcccccgccggacgtgaatattatgccgtttgagcaggccagcgggcataccattcataccattgcttccggtcctggttttccggaagatctcattcaccaggcactattaaccgccacctatgctgcgcgcgaatatttaattatgaccacgccatatttcgtccccagcgacgatctgctgcacgccatttgtaccgctgcgcagcgcggcgtggatgtcagtattatcctgccccgtaaaaatgattcactgctcgtcggctgggccagtcgcgcctttttcagcgagttactggcggcgggcgtgaaaatctatcagttcgaaggcgggctgttgcataccaaaagcgtgctggtcgatggcgaactgagcctggtcggtaccgtgaatctcgacatgcgtagcctgtggcttaatttcgagattacgctggtcattgatgatacgggtttcggcgccgatctggctgcggtacaggacgattatatttcgcgctcccgcctgttagatgcgcgtttgtgggtaaaacgtccgttatggcagcgtattaccgagcgattgttttacttctttagtccattgctgtaaaacgtgaccaacatgagtaaacaggtagtcactatggaaatggatctgaacaatcgcctgactgaagacgaaacgcttgagcaggcttacgatatttttcttgagctggcggcggataatcttgatccggctgatatcattctgttcaatttgcaattcgaggagcgcggcggcgcggagttgtttgatcccgctgaagactggcaagagcacgtcgattttgacctgaatccagacttttttgccgaggtggtgattggcctggcggataccgaagacggcgaaattaacgacatttttgcccgcgttctgctgtgccgggaaaaggaccacaagctgtgccatattctctggcgcgaataagcggttcaggccggatggcgtctgatagcgccctccggcaagcctgtttaatccggtagcttactgccgcatcggttacaatattgcgcgctatgttcatgctggctttgctggcactgcggacattttcgctgccagtgacgtttttgaaacgcgctgctcatgtgcgtggtaatcagtcctgtaggaatcgcaatcaccgaataaccaatcaaaataagcaccgacgcgacaatacgtcccagcggcgtatgcggcgtaatatcaccgtaccccacggttgtgactgtcactatcgcccaatacaccgaggcattaagcgtcgtgaagccatatttcggtccttcaataagatacatcagggcaccgaaaataatcatcacgatcgcaataaatgaatagaacagaataagctgatgacgcgcgctaataatggcgctccagaatacgcgcagggatggcataaaacgtagcagtttaagaatacgcagcacgcgaatcgctcgcatagcgcgccaggcaaacatatagttcaggctaatttccggccatagccacatgacgtacagcggcaaaatcgtcaccagatcaataaatccccagaaactaaaaacgtattttgccggttcgggccaactaaacagtctgagcaagtattcaccggtaaatatcagggtaacgcacagctccagccagacaaaaatatgccattcatcaaatgtcaggtgatattccgttcctacgcctgattcaacaaaaatgaccagtacgctaagcagcgcaaacagcgcgcataacccttcaaaacggcgacttgagcgcgtagtcaaatcgaacagattatgataaagacgacggcgaaccgacgacaaagaaagtgacacggtaacctcacctaaaagaagggctgacgaattgtcagcccttgcgattataacgggtctactttaaggcaggaaacggcatggcgaaaactcccttccaacaccggtcgcgtttgcgcgcattctggcccggctagcggacagcgtgtacggaacacgcagccggaaggcgggttaatgggcgaaggtaattcgccctccagcaattgtatcttcttatttcgctccagatcgggatcgggaatcggtaccgccgacatcagcgctttggtataaggatgcagtggattatggtacacctcatcataggtgcccaattctaccgcatgaccgagatacatcaccaggacacgatcggatatgtgctttacgaccgccagatcgtgcgcaataaaaatcaacgacagccccatctctcgctgtaactgctggagcaaattcaccacctgcgcctgaatagaaacgtccagcgccgacaccggctcattgcaaataatgagcttaggctccaggatcaacgcccgggcgataccgatgcgctggcactgccccccggaaaactcatggggataacggttgatgagattcggcagcagccccactttcagcatcatggctttcacgcggtcacgcacgtcctggcgcgaaagcttaggatgataagtgcgcagcggttcagcgataatttcgccaatcgtcattcgcgggttgagtgacgccagcgggtcctggaaaatcatctggatgtcgctgcgcacctcgcgccactcatccgctttcatgcccaacagatcttttcccagccaggcgactttaccgtctgtcgccttcaccagaccaataatggcgcgcgcaaacgtcgacttgccgcagccggattcccccaccacgccaagcgtttcgccttcatacaggcgtagcgtaacgccgtccaccgctttcagggttttcggcggttgccagaaccactgcttcccttctttgatatcaaaatgtacttttagatcggcgatttcgaggagaactttacgttgttcaatcacagcattcatagcagttcctccaccggtttaaaacaggcgcgcaagcgaccaggactgaacgcttcaagtggcggcgcattattgcagatctccatcgcatgaggacaacgcggctggaacggacaacctttaggcaaacgcaataaattgggaggattgcccggaatcgtcagcatttccgccccctcgctatccagacgcggcaccgcattaagcaagcctatcgaatacggatgaacgggctgataaaagacatcgcgcgccttaccgtattccatggtacgcccggcatacattaccaggaccttatcgcaaatacccgcgaccacgcccagatcgtgggtaatcatgataatggcggtattaaattcgcgctttagctcattaagcaaggtcataatctgcgcctgcacggtaacatcaagcgcggtggtaggctcatcggcaataagcagtttcggcctgcacaacagcgccatcgcaatcatcacacgttgacgcattccgccggaaaattcgtgcgggtacattttcatccgtttgcgcgcttccggtatttttacggcatccagcattctgacggactcttcaaaagcttccgctttgctcattcctttatgcagcatcaggacttccattaactgctccccaacgcgcatataaggatttagcgaggtcatcgggtcctgaaaaatcatcgaaatctgttctgcgcgcagcgtattcagttcgcgctcaggtagattaagaatttcacgtccgttaaaggtcgcggaaccgccgattcgaccattcgtcgccagcagtcccattaatgcgaacgccgtttgcgatttccccgatccagactcgccaacaatacctaacgtttctccagcgcgaagcgtaaagttcagatcgttgaccgccgtcacatcgccatcaggcgtagcgaacgtaacacgaagatcgtttacctccagcagtacattcgccggttgcggcgcctgagttgcggtttctgataagctcatggctgtactccttaacgatcttttgggtcgagggcatcacgcaggccatcgccaataaagttaaaacagaataacgtcaccacgagaaagccagccggaaacagcagcagccacggtaagacttccattgaatttgcgccatcgctcaacaacgctccccaactgcttaacggttcctgcgtcccaagccccaggaaactgaggaaagactcaaacagaatcatgctgggcaccagcaacgatgcatacactaccactacgcccaggacgttaggcacaatatggcggatcacaatgctggcggtcgacacaccacccacctgcgcggcttcgatgaactctttacgtttaagacttagggtttggccacgcacgatacgcgccatatcaagccaggagaccatgccgatggcgacgaaaatcaacagaatgttctgccaaaaaacgtcaccagcaaaatcacaaagaacataaacgggaacgagttgaggatctccaacaaacgcatcatcacagaatcaattttgccgcccagatacccggacagcgagccatacagcgttccgacaatgaccgccaccagcgcggcggcaatcccgaccatcaatgagatacgcccgccgatggcaacgcgcaccaacagatcgcgcccggaagagtcagtgccgaaatagtggccggacgccatatccggcgcgctggacatcatgccccagtcggtatcgaaataggtaaattgcgacagcataggcgctactgtcacgaatagggctatcagaaacaggacaataagactggccaccgccgcacggttatgcataaagcgccgacgggcatcttgccaaaggctgcgaccttccacctccagcttttcactgaaattttccagcgtctcgctgtttttcttacttaacatcatcgcgagctccagtatcaatagcgaattttcgggtcgataacggcatagagcacatcgacaatggcgttaaacaatatggtcagcgccccgactaaaatggtcaaacttaacaccagcgagtaatcgcggttgagcgcgccattaacgaaaagctgcccaatgcccggtaagccataaatcgtttcaatcaccattgagccggtaataatgccgacaaaggctggccccatataggataaaaccggcagcagcgcaggttttaacgcatggcggaagatgattctgcgcatcggtaatccttttgcccgcgcggtacgaataaagttcgaatgcagaacttcaatcattgagccgcgcgtaatacgagcgatgctggcaatataggccagtgaaagcgcgaccatcggcaggatcataaattttaacgccccgccgttccagccgccgccaagcagccattgcaaggttattgcaaagaccatcaccagtagcggcgctaccacaaaactggggataacgacgccggtcatggcaaatcccatcaccgtataatcccatcgcgtattttgctttagcgcggcaatcacgccagcgctgacaccaataatgaccgccagcaaaaaagcggcggcgccaagtttcgccgaaacggggaagctggcggcaaccagatcgttgaccgtgtaatctttatatttaaacgatggtccaaaatcgccatgcgccagctgcttcaggtagctgaagtactgcgtcatgatgggatcgttcagatgatattttgcttcaatattggccagcacttccggcggcaatgcgcgctcgccggtaaaaggactccccggcgcgaggcgcatcataaagaaagagatggtaataagaataaacagcgtcggaatcgcttccagacagcggcgtaaaataaatttcaacattgcccgtaccttctggcctgtgcctttacttcccggacgtgacaaaagatccgccagggaaagttatagtgcgatgaaaaaagacaccatgggacaaccgcagttgtcccatgtcttgccattaatgtttgataatatataagtttttcacataaatattatccagcgggtctttaccggtatacccgcccacccagggtttcaccaggcgcgcgttaacgtagtaatacaccggcacaatagccgagtctttatctaactgctgctccgctttagcgtagagttcgctgcgctgcgtatcgtccgccactttcagcgtgtcggcaatcagcttatcaaacgccgggctcttataatgcgcggtgttatttgaactgtcggacaacatggtattcaggaacgaggtcggttcattataatctgcgcaccacccggctctggcgacatcaaaggtgccctgatgacgggtatccaggaaggttttccattcctgattctccagattcacattgacgcccagatttttcttccagatagacgccacggcaatagccagttttttatgcagatcggaggtgttatacagcaggtcgaatgttaagggcttatccgccgtaaagccggcttcagccaacaatttcttcgcttcttcattacgcttttgctgggaccatttgaaccactcaggctctaccagttttgcgccatcggtatacggcggcgtgtagctataagcgggtaaatcgccctgatttttaaccttattaacaataatgtcgcgatctaacgccagtttcagcgcggtacgcacgcggacatcgttaaacggcgctttttgattattaatttcgtaataataggtacacaaataagggtctacgcggacttcattcgggatctctttcttcagtttctggaataattcgatcggcatattgttataagtcatatcgatctcgccgctgcggtagcggttaacatccgtcacctccgaagagataggcaaataagttacctgattgatgacggttttgtcgttatcccagtattgcgggttacgctccagcacgatacgttcgttcaccacccaattttttaacttataagcgccgttagtgacaatattggctggttgcgtccatttatcgccaaatttttcgaccgctgatttcggtacaggagacactgaagggtggaccaacaatttgtagaaataaggcaccggctcacttaaggtcactttaaaggtgtgatcatcaagcgcttttacccccagatcggtggcgggttttttaccggcgataatgtcatcgatattaacgatatgaccgtattgcagatagctggcgtacggcgatgccgtattaggatcggccaggcgttgccagctataaacgaaatcatgggcggtgacgggcgtaccatctgaccatttcgcattttcacgtagatggaatgtccagactttaaaatctttattttcccatttttccgcgacgcccggtgaaggatgcccctcgacatcactaattaataagccttcaaagagatcacggctgacgttcgattccggcacgccttcaattttatgcgggtcgagagactgcacttctgatccattattacgtaccaacgtttgcttgtcggctaactgaacaccggcgggcacgtctgccgcagtcgcggcgctggcggcgatgaacgcagtgagtattcccactgcaattaaactttttttcgtgatgttagacattgtgtttgtactccactcattataattactggtttttaccagcctgtttaatcccgtcagggctcctgtacagcactggtggtgtactgccaggtctgtcactgcttttgctatcaccgactttatttattctgacgattcgttcgatcgctttcgtcgattcggtatacgacgtacctgcccacgtcgcacgttatttctgacaaccatgtaaatgaaaatagttatcaacaatgtgaaatcttctgcaaaatgtttggccgaaaagtatcaaatgcgtttctgaaccgccaattcattttacaattttgttaaccaattctcttttatggaaaattgcctgcccagaaaaacggttaaagaatgttaaaaatctttgatttattctttataatcaataagttgaaagaaaaatatctctctgtcgcatcgtaggttatgcctgcgccagaaaacacacacaaatttaacaaatgctcattatttagcacattcatctacgatggagctgaaacaactaataacatttcaataatccttcatcaagccccagagtatggtgtgaataaaataacagacctaccgcttctcacggtctcagtaatgttcataatagattgattaataaaaataaatagcgttagattatattagtattttttatcatttaaacgctgaatgcttatcaaagtaagaagtgttacgtgggaatgtcactgggaatgtcacaaggcggcccccttagggcgccgcctgtaaatcaacaggtgggagtttagttgagcaagccggggaaaatgccttttattcctgtgacaataaattcgatgccgagcgccattaacaacaaccccatgattcgggtaataacgttgataccggtttgccccagcaaacgaaccagccacggcgccatacggaacacgccccagcagcaaagcgcaaaaagcgcaatggcaactgaaaaaccaagcaaatgcgcgatgctgtgataacgcgtcccccagacgatagtggagctaatcgcccctggccccgccattaacggtagcgctaacggcacaacgccaatgctctcgcgtatggccgtctctgacttttcttgcttgttttgtttatcttcccccagcttcccgctgatcatcgacattgcaatggtgacaaccaggataccgcccgcaattctgaacgaatcaatagaaataccaaacagctgcaggatgccatcgccgaggaataaggaactccacaagataatcgcgaccgacagattcgcggtgaggttagttttattacgcgccgtggccgtctggtagctggtcatgctgatgaaaacgggaataatccccaccgggttaaccagcgcaaagagcccgataaagaacttaaagtaaacaggaaaatcaaaaagcggttgaatcacggttagctccgaagcgttagccggatgaagtcaatgttcgttaatgatcaaaacgcgcagaagatacgccttttattcgcatagttcacctcttatctacacctaatttcatccattcatcgctgttatttatatgtactcgttatgctaatccacttactcttcatgacaacgatttcttaacaatttacataaaaggctaaaatggcctgctgaaaggtgtcagctttgcgtaatcttgatttagatcacacaatcgctactcagaagtgagtaatcttgcttacgccacctggacgtaacgcgttagagttaaatgatactaacgcagaagctcttttagtaaatcagagcgaaacggacgttaagtaaccacctgaatttcaggtatttatacaaagtatcgtcgatctgtctatactcacgtatcgcgcagatgatttactaaaaaagtttaacattatcaggagagcattatggctgttactaatgtcgctgaacttaacgcactcgtagagcgtgtaaaaaaagcccagcgtgaatatgccagtttcactcaagaacaggtcgacaaaatcttccgcgccgccgctctggcagccgctgatgcccgcattccgctggccaaaatggccgtcgccgaatcaggtatgggtatcgtggaagacaaagtgattaaaaaccacttcgcttctgaatatatttacaatgcctataaagatgaaaaaacctgcggcgtgctgtcagaagacgacaccttcgggaccatcaccattgctgaacctatcggcattatttgcggtatcgttccaaccactaacccgacctctactgcgatcttcaaatcgctgattagcctgaagacccgtaacgccatcatcttttctccgcatccgcgcgctaaagaagcaactaacaaagcggcagacatcgttctgcaagcggctatcgctgccggcgcaccgaaagatctgattggctggatcgatcaaccttccgtagaactgtctaatgcgctgatgcaccacccggatattaacctgatcctcgccactggcggtccaggcatggttaaagctgcatacagctccggtaaaccggcaatcggcgtaggcgcaggtaacaccccggttgtcattgatgaaaccgctgatatcaaacgcgctgtggcgtctgttctgatgtctaaaaccttcgataacggcgtaatctgtgcttctgaacagtctgttgtcgttgttgattccgtctatgatgccgttcgcgaacgtttcgccagccacggcggctacatgctgcagggccaggagctgaaagcggttcaaaacgttattctgaaaaatggcgctctgaacgccgctatcgtcggtcagccagcctacaaaatcgctgaactggcaggcttctccgtaccagaaaccaccaagattctgatcggtgaagttacggtcgttgacgaaagcgaaccgttcgcacacgaaaaactgtctccgactctagcgatgtaccgtgcgaaagatttcgaagaagcggtagaaaaagcagaaaaactggtcgctatgggcggtatcggtcacacctcctgcctgtacactgaccaggataaccagccagaacgcgttgcttacttcggtcagatgatgaaaaccgcgcgtatcctgatcaacaccccggcctctcagggtggtatcggtgacctgtacaacttcaaactcgcaccttccctgacgttgggttgtggttcctggggtggtaactccatctctgaaaacgttggtccgaaacacctgatcaacaagaaaaccgttgctaagcgagctgaaaacatgttgtggcacaaacttccgaaatctatctacttccgccgtggctctctgcccatcgcgctggatgaagtgattactgatggccacaaacgtgcgctcatcgtgactgaccgcttcctgttcaacaacggctatgcagaccagatcacctctgtgctgaaagcggctggcgttgaaaccgaagtcttcttcgaagttgaagcagacccgacgctttccgttgttcgcaaaggcgctgagctggctaactccttcaaaccggacgtgatcatcgcgctgggcggcggttccccgatggacgccgcgaaaatcatgtgggtcatgtacgaacatccggaaactcacttcgaagaactggcgctgcgctttatggacatccgtaaacgtatctacaagttcccgaaaatgggcgtgaaagcgaaaatgatcgccgtcaccaccacttccggtaccggttctgaagtcacaccgtttgcggttgtgaccgacaatgcaaccggtcagaaatatccgctggctgactatgccctgaccccggatatggcgattgtcgatgccaacctggtgatggatatgccgaagtccctgtgtgcgttcggtggtctggatgcggtaactcacgccctggaagcttacgtttccgtactggcttctgagttctctgacggtcaggctctgcaggctctgaaactgctgaaagaaaacctgccggcgtcttaccacgaagggtctaaaaacccggttgcgcgtgaacgtgttcacagtgcagcgactatcgccggtatcgcgtttgccaacgccttcctcggtgtatgtcactccatggcgcacaaactgggctctcagttccacattccgcacggtctggcgaacgccctgctgatttgtaacgttatccgctacaacgcgaatgacaacccgaccaagcagaccgctttcagccagtacgatcgtccgcaggcacgccgtcgttacgctgaaattgctgaccacctgggcctgagcgcgccgggcgaccgtaccgccgctaagattgaaaaactgctggcatggctggaaagcattaaagctgagctgggcattcctaagtctatacgtgaagcaggcgtgcaggaagctgacttcctggcacacgttgacaaactgtctgaagatgccttcgatgaccagtgcaccggcgctaacccgcgttatccgctgatctccgaactgaaacagattctgctggatacctactacggtcgtgatttcaccgaaggtgaagttgcagcgaagaaagacgtcgttgccgcaccgaaagcagagaaaaaagcgaaaaaatccgcttaattcgttatctgttttagcatgacaataacggcctcaattgaggccgtttttttgttttacctgtttatctgatgcctgaaggcgctatgcttaccatctggcctacgcgctcacggcacgcccttcgtcaggaggcctgaataatgacctccaaagcgctacagggcgttttataagccgatctttacctcaggtatcatatgtgccgatggcgctcctgaatcgccgtcagtgagccctcctccagcgcgtccttataatgcttacggcaaactgaaacgtagcgttcattcccgccaataaccacctgttcgccttcgttataaggcctgccgtcctgatcaaggcgcaaaaccatactggctttacgaccgcagaaacagatagtttttaattccaccagcttatctgaccatgccagcaagtattggctgccgacaaagagctccccacgaaagtctgttcgtagcccatagcagagtactggaatatctaatttgtcgacaacctcggataattgataaacctgctggcgagtcaaaaactggctttcgtcgactaacacgcaatgtattgtctgccgcgcgctctcggcacgaatctcttcaaacaaggatgtattttggttaaacaattttgccggcgacgacaaaccgatacgagagctgactttgcctgcgccgaaacgatcgtcgatttccgccgtatatacgacggtacgcatcccgcgttcctgataattgtatgaagattgcagcagtgcagtcgacttacccgcattcattgccgaatagtagaaatatagctgtgccattggtcgcaggacctcacctgagtgaaataaagattggcgggattgtaccataatttaccgatgcgacggcgcggctcgcgctccggtgagtattaagaattgtacaaacatcgctcactatacccaaaataattcgagttgcttaaaggcggcaagggagtgagtccccaggagcatagataactatgtggctggggtgcgcgagcgtagccaacacataagcaacttgaagtatgaagggtatatacacattccttcacaaattatgccgttaaaattcatcaacaatgcttatcatcacccgccaatatgaaaaccttgtacttattgttaccgttactcatacccaatgcaaagtaatagggttttcttgtaaggaaagctaatacaagagattgatatctctgcaatgagatcgtatttcatcatgataaaatgtgacctgaatcctaaatttttagtgacagacggtgagtatcccccctggcaataagctcttttttgtgcggcgcctcaaggaaaatttaagttgagataattaaaacgtgtgcttaataaagcgtaattttgaattccttacattcctggctattgcacaactgaatttatcgctctattattagctcaacaaaccaccccaatataagtttgagattactacaatgagcgaagcacttaaaattctgaacaacatccgtactcttcgtgcgcaggcaagagaatgtactctggaaacgcttgaagaaatgctggaaaaattagaagttgtcgttaatgagcgtcgtgaagaagaaagcgctgctgctgctgaagtggaagaacgcactcgtaaactgcaacagtatcgtgaaatgttaattgccgacggcattgacccgaatgaactgctgaatagcatggctgccgctaaatccggtaccaaagctaaacgcgcagctcgtccggctaaatatagctatgttgacgaaaacggtgaaactaaaacctggactggccagggtcgtacaccggctgtaatcaaaaaagcaatggaagaacaaggtaagcaactggaagatttcctgatcaaggaataatttacttcctggatgcttaaaatcccgccgctggcgggattttttttgcctgagttctccgctgacgaccccaggcataaaaaaagcgccggatttaccagcgcttctgttaaaaaatttataacgtatcgttacttcttaatacccatttcttcttcaagccaggctttaaattcagcacccagcgaattatgacggatgccatattcaacgaatgcctgcatatatcctaacttattaccacagtcatggcttttacccttcatgtggtaggcttcaaccgtttctttttcgatcagcatatcgatagcatcggtcaactgaatttcatccccggcgcccggaggggttttcgccagcaacgcccagatatccgcgctcaacacataacgcccgacaatcgcaaggttagacggcgcgacatccgcttttggtttttcaaccacgccaaccatcggcacactttcgcccggcgccagctcaacgcctttgcaatcgaccacgccgtatgcagtcacatcttctactggctcaaccataatctggctattgccggtttcgtcgaaacggcggatcatttcagccaggttatcctgagacaggtcggactcatattcgtcaagaataacgtctggcagaataacagcgacaggttcgtttccgacaacgggatgcgcgcacaatacggcatggcccaggccttttgccagcccttgacgtacctgcataatagtgacatgcggagggcaaatagactgaacctcctccagaagctgacgcttaacgcgtttttccagcatcgcttccagctcaaaactggtatcaaagtggttttcaatagagtttttagacgagtgcgtaacaagcacgatttcagtaatgccagcagcgatacattcgttcacgacgtactgaattaatggcttatcaaccagcggcagcatctctttcgggatagctttggtcgctggcagcatcctggttcccaatcccgcgaccgggataacggcttttttgactttcgaattaagggcagccatttaaaattctcctggactgttcatgtattgaacgtgttcattaatctgtatcgtgttccagtatatcagtaccagaacaagcctcaggtccaaaaaggacttatattggtataattaagacaaatacttataaatctgccgcagatagtaacactcgtcgggaaaggccggtaaagcaatttccgctcactcttccgtttggtcattccgcagacaacatcaatcgcagacgccctcctgcgccccatatttgacactgccacgagtcgcaacgctggcttaattggttaaggtaggcgttacccaatgttcctagcggcacgccgctgctaatttgaacctgatgagcgcccgtatttaaggtggcgttcaatccggcggagacgagaatcaaatttttgagctcactgtgatagtagccgacaaatagcgggaattgcccaggtaaattggcttgtctgagcagatgatttacctgttttaatagcgcgcctaactccggtaaacggtgcttttgttggccgagctgatcctgcaataagccgttaaatagcgcccgcagcaacaatgcggctaacacgccgttatcgcccgcccgggtgacatccaggcaataaaatgccagttcgttatcagatagcggcgcaatatccagcaccagtccaggctgatcggcggagacgagctgccggtaattaatgcggcaatgagaaatcacctgctgtaccgggggctgcaattcctgcaacaattgcgctgcggcggtcggattactcaccattgcatcccagtcacgaaacaggcgttcttcttcttcaacccgcgagttaaacatattagggtataagcaagcgaatacggtttcccgcaagcggttgagatcttttaccggcttcagcaagacatcttcaaccccaaggcgtaacgctttggcgatatccgccatattttctgttgcggaaataaccagaataggcgtctggtctccgcgattacgtaagttttctaccagtttgagaccgttcattctcggcatagcgatatcacatatcatgagatcaggggtaaaacgccccattaactccagggcatccaccccgtcgcctgccaatgccgttgtcgctcccaaagaggaaaaccacgaatccagaagcgagcgaaatacaggctcgtcttcaacaataagaatctgttttccgaccaatggctgcgtcatgttctctcccctgactggctttaatcaatagtggcatggtattgccgcttgcgcctgtcagaatttgcttaagtgatcgtaaaaggtacattaaacgtcggtacgcaccaagggtataagttcgtccatctttttctctacggctaactgacccgccgcaatagcggcatgggcgcgatgaaaatccagcgtagagatttgcggacagaatggttgaatgagaatatcaggcggatcgccagccatacggttacgtttaagacgattttccaacacctggatggaggttgtcatgatttccattgccccagacgaactcacgccacggcgtgaagtcaggctactgaaacgttcttttaaacgcttatgccagggcagcgcatcatcgctctcttcattgatattcccgacatttacagagagcaaatcttgctgcatgaggtgggcatcatgttgcaggtctaccgcaataacgatatcagcccccagcgccctggttaacgaaacaggtaccggattaacgactgcgccatctaccagccagtaaccgttatgttcaaccggagacatcagccctggcatactgcacgacgcgcgtacggcaaggtgtagatcgccttcagtaaaccatagctctcgtcccgtgctaagattcgtcgcgaccgcgccaaaacgtcttgaacagtggtcaaaatccgtgacgggcataatatcccgatagtgattaaatacgcgtttgccgcgaagcaaccctcctctgccccaggatacatccatcaggcgtaaaacatcccagtagcggaatgaacatacccactgttcaagcgccgataatttattacaggcatacgcggcgccgaccagtgaacctattgagcatcctgcaacgatatcaatatcaatgcctgtttgcttgagggctttgatgaccccaatatgagaccatcctctcgctgcgccagatcccagcgccagccctattttcatttttctcatcgtacttaacgacttcccctggcttcaagacgtagcaacatcgccactgctcagttaacataatgccaccctggcgttcaacgccgttttatattcagggagattattgtgtctcagccttgtccctgtggtagcgctgacgagtatagcctatgttgtggtcgtattgtgtccggagaacgagtagcacccgatccgtcacatctcatgcgctctcgttactgcgcttttgtgatgaaagacgcagattacttaattaagagctggcatccaacttgcaatgcggccgcgtttcgtgatgatatcatcgccggatttgccaataccaggtggctcggcctgactatttttgaacatacctagtcagaagcagaaaatacagggtatgttagttttatcgcgcgtttttccgaacaagggaaaaacggggcgattatcgaacgttctcgttttatcaaagaaaacggtcagtggtattatattgacggtacccgcccgcagttgggtcgaaatgatccctgcccgtgcggttcaggcaaaaaatttaaaaagtgctgcggccagtgacgcctgacagtattgatacagcaaacactctcaacaggatttttccggcaatgcaatcactacaacgtaaagttctgcgtactatttgtcccgatcaaaaaggccttatcgcgcggattaccaacatttgctataagcacgagcttaatattgtgcaaaacaatgaatttgtggaccatcgcaccggacgcttttttatgcggaccgagctggaaggcatcttcaatgattccactcttctggccgatctggacagcgccttaccggaaggctctgttcgtgaactcaatcccgccggacgccgtcgggtagtgattctggttaccaaagaggcgcattgtctgggcgacctgctgatgaaagccaactatggcgggctggatgttgaaatcgccgcggtcattggcaaccatgaaacgttacgctcgctggttgaacgttttgagatccctttcgaactggtcagccatgagggattaacgcgtgaagagcatgacacgaagatggcggacgccattgatacccatcaaccggactatgtagtgctggccaagtatatgcgtgttttgacgccaggttttgtggcgcgcttcccgaacaaaattatcaatatccaccactcattcctgccggcgtttatcggcgcgcgtccttatcatcaggcctatgagcgcggcgtgaaaatcatcggcgctaccgcgcactatgtgaatgataatctagatgaaggcccaatcattatgcaggacgtgattcacgtcgatcacacctacaccgcagaagatatgatgcgtgccgggcgcgacgttgagaaaaacgtattaagccgcgcgctgtatcaggttctggcgcagcgggtctttgtttacggcaatcggacgattattctttaatcgtcagtaatatgaattgattagctttaatccgttacggatgaaaagtacgcaaacagttcatttcaggcaaaggaatgctttacagcgacgtgtcatttgatatgatgcgccccgcttcccgaaaggaagcgggccagtattaagcattaccccgtggtggggttcccgagcgatcataagggagctgactgcaaatctgccgtcatcgacttcaaggttcgactcgagcaatagtgagagaacgttgccgcaggcaacggcccgaagggtgaggagctttagctccgaataatccttcccgctatagaatgcaagcagcataatgaatttatcccgtggtggggttcccgagcggccaaagggagcagactgtaaatctgccgtcatcgacttcgaaggttcgattcgagcgcagcgagaaagcgttgccgtaggcaacgacccgaagggcgaagcgcgcagcgctgagtcatccttcccccaccaccatcatgatcttcagaaagcatctaaccttcattcgacatcggtttgtcataattctacccatgtggggaaggatgagaagcttcgactaaggttcgattcgagcgaaagcgagagaacgttgccgcaggcaacgacccgaagggcgaaacgcgcagcgctgagtcatccttcccccaccaccattacttcataaggcaccaatttcaaatcaatcagcactgccccgtatccttaccccacaggcagacttcacaccatggcgccatagcttattggctatcttatcaatacttcttcctggcaatctttttcgcctcctttgactggttgatttttcgcctgatgagatcaaaggcggcatatgtctcgctaagttgatctggggtaagcgttcccttgagtcggtttctttcggcaatgagcgctgaacaatcatccttagatttttccgtatatatacttgccatgtaataccaaatataggcctgcttattatctttaggcaccccctggcgcccatgagcataaatttccccaagcgctaattgtgccggagtaaacccctgctctgccgctttaaggtaccacttcagcgcattccggctattttcaggcacgcctcttcccatgctatatgctacgccaagctgatattgcgctttcgcaaaatcctgttttgctgcttttcgataccatgcgatagcctgtctgtcgctttgcgcgacgccgcgaccaaaagcagacatgatgcccagatgcgtttgcgcagcaggcagtccctggcgtgcggctttgcgataccacgccagcgcctgttggtagtcctgagaaacggcctcgccctgcataaacatcacgccgatcgcatcctgcgcctcggccaatccctgcgctgcggctctgcgataccactccagcgccagattgtgatctttcaataagtgataaccgttgtaataccatacgccaaaattgaactgtacctttgccatcacgcgttgcgctgtttttcgataccacgtctgagagtgaacctggtcagcgggatgcgctttatcatagagcgcattcagcggaatgtggcctggcgtatagctgcctggtataccttcattaagccagtaaactgcctgacgataatcctgaggcacgccttcaccataaaaataggcaacaccgagataaagttgcgcggggtagtacatattttccgccgctttacgcatcaagatcgccgtttgctgataatcctgaggaacgccctgaccgtgggcgtacattactccaagcttaaattgtgctgacgaagctgaaccctggccgcggacaacgcccgcatcattggttggagaggcggcttttcgataccactccagcgctagctgggtattttggggaaacccatcgccatacatataggcgtcaccgaggatttcttgcgtactactatcccctagttctgccgccttgcgataccactccagcgctttttgccgactaagtggaaaattttcaccatagttgtaatgatagccaaggatgaaataggaaaaatcagaaccttgtttacccgctttctccagccattttatggctagtttataatcaggcttaacgtatcgcccctccgcataccagcttccaagcgagaactgcgcgccttcatctccttgttccgctttttgctctaattcctgaacgtactggcattcttctgagtcggggggatagcgctcctcgcagacagcagcgtgagccatttttgaaataaatatatttaatattattattttgaaaattgatgaaaaacgcatacaactatccttattgtcgtttatggcgtgattatatgctgcatcatcctttttctgcttacaaaaaactcgcacagatgctgaataaacccagaaacaaagagtccggattcagatgccagacatggcagacccgctgtaaacgaaacaaggcggcggtcgataaggcatttatgctgcactccggcaaacagccataaaaaaactccgccgaagcggagtttagggcatcgagagaaaatcagtgacgcgcacgtacaatctggtatttgcgggtcaggtactcgaccggcacgctccagatatgcaccaggcgcgagaatgggaataacaggaacagcgtcatccccagtaccaggtgcatacggaagataaaggctacaccgtccagatgtgcggatgcgccaccgtggaaggtcacaactgactgcgcccacccgaccagcttcatcatttcactcccgtccatatgctgggcggagaacggaatggtcagcagacccagcgcgcactgaatcaccagcaatgagagaatcaaaatatctgcaccggtagtggtggcgcggacacgtgggctgaacagacgacgcttgagcagtaaaataccgccaaccagcgtcagcattccgcaggcgccgccggcaatcatcgccatcttctgcttcacgtcgaccggcagaaaagcttcatacatccagtgcggcgttaacatgcccaggaaatgaccggcgaaaatacccagaatcccaatgtggaacaggtttgacgccaggttcattcctttgcgatccagcatctgactggaagccgcccgccaggtgtactggccgtagtcgtaacgtaaccagctaccgatcagaaataccgatccggcaatgtacgggtagatatcaaagaagaacatattcaggaagtgcattagtgctgtcctccggtggtgatattcagatattgcggcgccacggccccggcaaaacgacgctggtgagcggagatttccgactcgccacacccttgatcggcgaagaatttcacctgctcttcttcccagaccgcatccaacgcctgcggggtatcatcacgtgcttcattcgcaattttttcagccactttgccgctgtcgataacggtattcgccagttttaacagcagatcgaacagcaccgcataacggctgtcacgctgttgcaaacgtgcgctgagcaacgccagaatcggcgcgatatcctgtaccccccctaacgcttcgcttttcggcaactgcgcaaggtattccagatacagcggcagatgatcgggcagttcgcggctgtcgagctgcaaaccgtgctgttcatactgtgccatcaggtcaaccatcgcctgaccgcgatcgcgggattccccgtgtacatgttcaaacagaagcagcgatgtggcgcgaccacggtcaaacagttcactataagcggcctgtacatccagcatgtcctgcgcggttaaatcgcgcaggaaaacgcccagagtctgggcatcctctttatccaggttctcagatgacgcgagcgcatcgaacaactcctgctgatgctgccacagggcagcatccgggtactcgagcagacgcgaaacaatgacgagttcaatcatgcgtgcggctccgttttgctggtcacatcaacagcgtcgatgcggcggctgttgaacagattgaatttggtatcagacccgtggcaaccatcgccgaaggtaaagccacaaccgcttttctccgggaatgcgtcacgcgccagttcacgatggctgctcggcaccacaaagcgatcttcgtaattagcaatcgccaggtaacgatacatttcctgcgcctgggcttcgcttaaacccacctcttccagcgcgcgggtatccactttaccgtctacggtttccgcacgtttgtagtgacgcatcgccagcatccgtttcagcgccaacagtaccggctgagtgtcgccagcggtcaacagattcgccaggtactgcaccgggatacgcagactgtctacatccggcagaataccgttgctgcccagttcacccgcgtcggcggcagactgaatcggtgacaaaggcggcacgtaccagaccatcggcagcgtgcggtattccggatgcagcggcagcgccagcttccagtccatcgccattttgtacactggcgattgctgcgccgcatcgatcacgctctgcggcacgccgtccttcagcgcctgctcaatgacagccggatcgttcggatcgaggaacacgtccagttgacgctggtacagatctttttcgttttccgtactggcagcgctttcaatggcatcggcgtcatacagcagtacgccaagataacggatacggccaacacaggtttcggagcaaacggtcggctgacccgcttcgatacgcgggtagcagaagatgcacttctcggacttcccgctcttccagttgaagtaaatcttcttgtacgggcagccggtgatgcacatacgccagccgcggcacttgtcctggtcgatcagcacgatgccgtcttcttcacgcttgtagatggcaccgcttgggcaggttgccacgcacgccggattgaggcagtgctcgcacaggcgcggcaggtacatcatgaaggtgttttcgaactggccgtacatcgccttctgcatgttttcgaaattctgatctttggcgcgtttttcgaactcgccgcccagaatctcttcccagtttggcccgctggtaattttgtccatccgctggccggtaatcagcgagcgcggacgcgcgatcggctgatgtttgctttccggcgcagtatgcaggttctggtagtcgtaatcaaacggctcgtagtagtcgtcgatgcccggcagatgcgggttagcgaagattttacccagcagcagcgcccggttgcccatgcgcggctgtagtttgccgttgattttgcggatccagccgcctttccatttttcctgattttcccagtcattaggaaaaccaacgccgggcttactttctacgttgttgaaccaggcgtattccataccttcgcgactggtccagacgtttttacaggtgactgaacaggtatgacagccgatgcacttatcgagattcagcaccatgccgacttgtgaacgaattttcattttacgctctcctgtacctggtcattgccttcgccatccaaccagttaatgttcttcatcttacgtaccaccacaaactcatcgcggttggagccgacggtaccgtagtagttaaagccgtaggctaactgcgcatagccgccgatcatatgggtcggtttcggcgtaatacgcgtcaccgagttatgaataccgccgcgctgctgggtaatttccgaccccggcaggtttacgatacgttcctgcgcgtggtacatcatggtcatgcccgccggtacacgctggctgaccactgcgcgtgcggtcaatgcgccgttgctgttgaagacttcgatccaatcgttatcttcaatgcccagctctttggcgtcggtttcactcatccatacaatcgggccgccacgcgacaaggtcagcatcaacaggttatcgctgtaggtcgagtggataccccatttctggtgcggcgtcaggaagttgagcgccttctccggattaccgttggatttacgccccatcaccgctttcaccgagcgggtgtcgatcggtgggcgatacaccagcagactttcgccgaagtcgcgcatccactggtgatcctgatacaactgttggcgaccagacagcgtacgccacgggatcagctcgtgaacgttggtataaccggcgttataagaaacatgctcatcttccagaccagaccaggtcgggctggagataattttgcgcggctgggcctgaatatcgcggaagcggattttctcttcttctttattagttgccagatgcgtatggtcgcgaccggtaaactcgctcagcgccgcccaggctttcactgccacctgaccgttggtttccggcgctaacgtcaggatcatctctgccgcgtcaatcgccgtgttgagcatcggctggcctttcgccggaccgtccgctttggtgtaattgagcttacgcagcaagtccatttcgctctgcgtgttccaggcaatccctttcccgccgttgccgattttctccatcagcgggccaatagaggtaaagcgctcataggtggccggataatcgcgctcaacggtcatgatgtgcggcgcggttttccctgggatcagatcgcattcaccttttttccagtctttcacgtccagcggctgtgccagttcagcggcagagtcgtgctggatcggcagcgtcacgacgtcagtctctttacccaggtggcctacacagacttcggagaatttcttcgcaatgcctttgtagatttcccagtcgcttttcgattcccaggccggatctacggcggcagacagcggatgaataaacggatgcatatccgaggtattcatatcgtctttttcataccaggtggcggtcggcagtacgatatcggagtacaggcaggtgctcgacaggcggaagtccagcgtcaccaccagatccagtttgccgtccaggccattgtcacgccattccacttcttccggcttcacaccgccctgcttgccgagatccagcccctgaataccatgctcagtacccagcagatatttcagcatatactcgtgacctttaccggaagacccaagcaggttggaacgccagataaagaggttacgtggatggtttttaccgttttccggctgctcggcggcaaagcgaatcgaaccgtctttcagggatttgacggtataatctaccggcgtcataccggctttttccgcttcacgcgcaatatacagcgggttggtgcctaactgcggtgccgacggcaaccagcccatacgttcggcgcgcacattgaagtcaatcagatggccgctatagcgggatttgtccgccatcggcgacagtaactcctcggcggtcaccgtctcgtagcgccactggctggagtggttatagaagtaagaggtgctgttcatgtgacgcgcgggacgctgccagtcaagggcaaacgccagcggctgccagccggtctgcggacgcagtttttcctggccgacgtagtgcgcccagccgccgccgctctgaccaacgcaaccacagaacaccaacatattgatcagcccgcgatagttcatatcgaggtgataccagtggttcagaccggcgccaacgataatcattgaacgcccgtgcgttttgtccgcgttatcggcgaattcccgtgcgatacggatgatctgcgcccgcggcacgccggtgatctgctcggcccatgctggcgtatatgctttggtatcatcataactggcggcacaattttcatcgttcaggccgcgttccagaccatagttcgccatggtcagatcgtaaacggtagtgactaacgctgaagaaccatcggccagttgcagacgttttgccggcagtttatgcagcaggacgttatccagcgccacatgattaaagtactctgaaccctcgccgccgaaatacgggaagcccacgtcagcaatctcatcctggctgcccagcaagctgagctgcaattcagtttctgcaccggtagtcccgtcgcgctgttcgaggttccatttgcctttttcgccccagcggaaaccaattgaaccgtttggcgccaccatttcaccgttgctgttgatagcgacggttttccattccgggttattttcctgccccagcgaatcaacgagatcggcagcgcgcagcatacgacctgcggcataataaccatcacgctcttcaagcatcaccagcattggcatgtcggtatagcgacggacataatcggtgaagtactggcgcgggttgtcgaggtggaactcgcgcagcatgacgtggcccatcgccagcgccatcgccgcatcggtcccctgcttcggcgccagccacagatcgcacagtttggcgatttcggcatagtccggcgtcaccgcgacggttttagtgcctttgtaacgtacttcggtaaagaagtgggcatccggcgtacgggtttgcggcacgttagagccccaggcgataatatagctggagttgtaccagtcagcggattccggcacgtcggtctgctcgccccaggtttgcggggaggctggcggcaggtcgcagtaccagtcgtagaagctcaggcaggtaccgccaatcagcgaaagataacgtgcgccggaagcgtaggaaaccatcgacatcgccggaatgggtgagaagcccgcgacgcggtcagggccataggttttcacggtgtacacgttggaagcggcgatcagctcgttcacttcctgccatgaggagcgaacaaagccgccacgaccacgcgcctgtttgaagcttttggctttatcggcatcttcaatgatggaggcccatgcctctaccggatcgcgatgcagttttttcgcctcgcgccacatcttcatcagacgtttgcgcattagcggatatttcagtcggttagcgctgtagagataccaggagtaacttgccccgcgcgggcagccgcgaggttcatggtttggcatatcaggacgggtgcgcgggtaatcggtttgctgtgtttcccaggtcaccagaccatttttgacataaattttccagctacaagaaccggtgcagttcaccccatgggttgagcgcacaattttgtcatgctgccaacgttggcggtatccgtcctcccagtcccggtttgtttcgagaagctggccgtgcccatcggcaaaggtttcgcccttctgcttgaagtagcgaaaccggtccaggaatttactcatcgggtttctcctgtgtggaaccttacggctctctgataaatcgacattgcttaactaagggcgaaggtaacgcgctgaatgggcgtgagaattgataacgatcaaggcggacagggatgcaaatggcgcgcaaacctccggcatactccttttggaggaggagttttatttatatatattactgatttaattacataaaattaaatttacgcacgacatgaatgttaaattttcaacaagtgggtattaaggggtatccccctggatgaccgataaaaatgtgcgtggtcagccctgtcgcgcctctcttcttgactataagtatgttgtaactaaatgcgggtaaaaaaaagcgcggtctaacgccgcgcaaaggataatcaaaagttactttttatttttagaatgacgtccatataccgcccaggtaataacgacgcaggcgatatagaaaataagaaagactttcatcgcgccgactggcgaaccggttaatgctaaagatgaaccaaacgctttcggaataaaaaagccgccaatcgcgccaatcgcggaaataaagcccagcgccgccgccgtatcggtcgccgcttcacgcatggctctttcgtccgacccgccttccgcttttacccggtccatcgtcagtttacggaagataacggagatcatctggaaggtagaaccactccccagccccgccgtcaggaatagcgccagaaataccccgtagaatgcgataaagctaccgccaacgccgccagtaggtaatgtcaggaacagcagaccgctgaaaatcgccatcaggacaaagttgataagcgtgacgcgagtcccccccagacggtcagaaattgcgccgcctgccgaacgcgccagcgcgccgataaacggaccgaaaaacgcataatgcaggatctgcacatccgggaattgcgttttagacagcatagcgaaccccgcggagaaaccgataaacgatccgaaggtcgccagatacagcagactcatgatccacagatgaccacgtttgagcaccggcagttgctcttttagcgaggccttagacgtcgccagttcgttcatgccgaaccacgctgccagcgtaaaaatggccaggaaaggcacccaaatccaggctgcgttcgccagatagagctgagaaccgtccggctgctctacaccgtggctgccaaaggcggcaaagatagagagcgaaaccaccagcggcgcaaccagctgcatcacgctcacgcccatattgcccagaccgccgttcagacccagcgcgccgccctgcttttgtttaggaaagaaaaagctgatgttcgccatactggaggcaaagttcgcgccggcaaaaccacacagcaaggaaataataatgaaagtgctaaatggcgtactggtatcctgaacggcaaagcctaaccatacgcaaggcacgatgaggataccggtactgaacgctgtccagcgacgtccgccaaatagcggcaccataaaggagtaaggcacccgtagcagcgcgccggaaacagatggcagcgcagtcaacataaagagctgatcggtcgtaaaattaaatcccactttcggcaggttcaccgccactgcgctgaatagcatccagacgcaaaacgccagcagtaaacacgggacagaaatccacaaattacggctagcgacacgatggccgcgctgctgccagaacgccggatcttccggacgccattccgtgataacagcgccagttgccctttccggggcggatgagtgactcatagacacctctgattcttgatttgatgtctgccacattagggtttactgccgaaggtaagttgatataaatcaaaggaaaagtcgtcatcaccggcgactaaaaatagttattacccttaatgagtaggctattttggtaaaaaagctgtggtttttcaccatgctgtgtctgtctactccttcccgtcgcagatacctctttacggcggcaattaaggagtaactcgttataggtatgggtatactccgctgtatcgttgagaatagcggcacagccgattgacgcccccttttttgctacgttttttcggcgacattaccccgaagaaagaaggtaacatgtttaaacggtgtttctctcctcttacgctggttaaccaactggcgctgattgtcatgctctctaccgctatcggcgtggcggggatggcggtttccggctggctggttcagggcgtgcagggtagcgctcatgcgattaataaagcgggctcattgcgtatgcaaagctatcgactactggccgctgtcccgctggatgctaaagatcaaaagctgctggatgagatggagcaaacggcattcagccctgaactgacccgcgccgctgagcgagacgggcagcagaagcagcttaaagcgttgcaggattactggcataacgaactctcgccaaggctacagcacgcgcaaaacgcgcacgcggtcgcagaagatatcacgcgctttgtggcgggcctggatcgcctggtgacgtcgttcgaccatacgactgaattgcgtatcgaacgagtggtattagttcaccgggtaatggcgatctttatggcgctattgctggtatttacgattatctggctacgtgttcgccttttgcagccctggaaacagttgttatcaatggcgcgcgccgtcagtcagcgcgactttacccaacgtgccaatatcagtggacgcaatgagatggccgcgttgggttctgcgctcaataatatgtctgaagaactggccgaaagttatgcagtactggaacagcgagtacaggaaaaaacagccggtctggaacataaaaaccagattctctcgtttttgtggcaagccaaccgccgactgcattcacaggctccgctatgtgaacgtctttcaccggtactgaatggcctgcaaaatttaacccagttgcatgatattgagctgcgagtctatgacctggaagatgaagataatcaccaggaatttacctgtcagtcggacatcagttgcgatgataaaggctgccacctttgcccacgtagcgccctgccgatgattaacggcggcaccaccttaaaatggcggctcaccgactctcacacccaatacggtattttgctggcgacgctgccctatggacgccatctcagccacgatcagcaacagttggtggacacgctggttgaacagcttaccgcgactctggcgctcgacaggcatcaggagcgccagcagcggttgattgtcatggaagagcgtgccaccattgcccgcgaactgcatgattctattgcccagtcgctctcttgtatgaagatgcaggtgagctgcctgcaaatgcagggcgacgcgttaccggaaagcagccgtgagttactcagccaaattcgcaatgagctgaactgctcctgggcgcaactgcgcgaactgttaaccactttccgcttacagttgacggaacccgggctacgtccggcgctggaggcaagctgccaggagttcagcgcccggtttggctttacggtaaaactggattatcagcttcccccccgcctggtgccatcacaccaggcgatacacctgttgcaaattgccagggaagcccccagcaacgcccttaaacactctcatgccgacgatgtggtggtgacagtgacgcaatgtggcaaacaggtcaaactaaaagtgcaggacaatggctgcggcgtcccggaaaacgccgaacgcagtaatcactacggcatgatcatcatgcgcgatcgggcgcaaagtttgcgcggcgattgccaggtacgccgacgcgagactggcggaacagaggtcactgttacttttattccagaaacaaacttcacagaaacccagggagatacccatgaataatcaggaaccggcaaccatcctgttaatcgatgaccatccgatgctacgcacgggtgtaaagcagcttgtgagtatggcgcccgatatcagcgtggtcggagaagccagcaacggtgagcagggtattgacctggcggaatcgctcgatcccgatctgatcctccttgatttgaatatgccgggaatgaatggtctcgaaacgctggataaattacgcgaaaaagcgctgtcaggacgtattgtcgttttcagcgtatccaaccatgaagaagatgtcgtcacggcgctaaagcgcggcgcggatggttatctgttgaaagacatagagccggaggacttgctcaaagcgttacaacaggccgccgccggcgaaatggtattaagtgaagcgttaacgccggtactggcggccagcctgcgggccaaccgcgctaccaccgatcgcgatgtgacgcaactcaccccgcgtgagcgcgatattctgaagctcatcgcgcagggattgccaaataagatgattgcccggcgtctggatatcaccgaaagtacggtcaaagtgcacgtgaaacatatgctcaagaaaatgaagctgaaatcgcgcgtggaggccgccgtctggatgcatcaggaacgcatcttttaattattgctcctggaacggttgccaatgcggattatcgtccggcatcgtgataaacggttcagtcagcgcgagcgtgatctcattggaagagacacgctgacctttttcatcctcaaccaccaccgataaacgccagcgatttgccgcgccttcgcggtgatcccaggccggcataatgattgtccagccctcggtactgcgggtgtccgttcctgccgtcaaacttaatgcctgtgtatcgccctgccagctcaaatgacgaataccgtgcacgctgcgcacctgcaattttaacgcaaccgtctcaccaggcgtaagatcccagggcggcgtcgccagaaaaaccgttaacgttttacgctgccgatactccattgtcggcagcgagttacgttgcggcgtatcatagcggctaccgcgtaatgactggctttgcgccacttcactggcggcaagctgctttttgagcggcacgccgaagcggtagttaagcgtcagccccaggttattctgactgaccccgctctcgccctgtttgtgctgggcggtcatagtaagcaaaggtactggcgtatagttgagacccagttttaacgcgacaggattgtgataccccgttccggagtcaaacagatccacgctatcgccaaagtactgctccagactaacgctggtattgatatgctggtaaaacggcagccgcacttgcgcgttgatatcatatccgcgcgccattcgctgttctaaggtcgccgtatgcgtctgccagtcggcaaaaggctgataatagttggcggataaacgcaaatattctccccacgcctccgcgccaaagccggcgcgctgcagattttcatccagcagattatcgtaaaaggtattatagccaagaagccagccatcctgcgcccagcgctgtcctatgccaacgttgcttaccagtccgtcagtctgttgcgtaagaccaagctggctccaggtcagatagcgctgtttatcctgtaaagggataaaccagcttccgcgactgccgttaaaatgaccttcgttatcgacgttaatatccacgctggcgctgccccaggctgatagccagctttcaagctgctggttaacctgctcgctgaccacatcgcgtacctgtccgaaagcgaattgccgcgcctgttcaccggtatccagatcgttatttttcatgctggcttcgctaaacgctttggccatctcggcaaaatgcttttccccttcgtgggattccggcatcatgcctaaatccggcagacggttttgatcgaaagggtcttgcgcctgcgcacggatcgtaccgctggcagccagcaagagaagcgagagtgagaatgaacgaaaaacaatacggctcaacgtgtcggcaacttctacaacaaaagataagaggaatggcatcagagtaaaccataacgtgtccggacaggttttgcagccttttctcgtgtttccaggaatatccttattttttccgcagagcgtcccgggattttctccacgcatttggcggtacccggttcccgaggtaacataacgccattgccgacaaaatttctcaaggagaagggttatccatgcaaaatatcgtcattatcgctaacggcgccgcctacggcagcgaatcattatttaatagcctgcgtctggccattgcgcttcgcgagcaggaaagccatctcgatttacgcctgtttttgatgtcagatgccgtaaccgcagggttacgcggtcaaaaaccagccgaaggctacaatattcagcaaatgctggaaattctaaccgcgcaaaacgtaccggtaaaattatgcaaaacctgtgcggacggacgtggtatcactcccctgccgctgattgacggtgtggaaatcggaacgctggtcgagctggcgcaatggacgctggcggcggacaaagtgctgacattttgaatctgtacgcgggaaaagctcccgcgtcaggatagacttccggcaagaaaatcaggctaacgcgtgagtaataccgcgtttattttttcttatgccatttatcatcctcgcctttttcataatcgtttttaaccgccgcccaagcgactttgtgtgcggtttcctcgcgactggcgtcatcacgacgatcggctttatctttatattgctcccaggcgctattaaacgcttctttgtaaatgtcctgggcatgggctggaagaacattccgcacattatcgggtaaatcacttttggctttatacggcatcagcgcctccgtcttcagggaaaacattaagtgtggtaaacaatgcgttattacgccagtcgaggaggatttttgctttttacggaaattaactttttgttatttaaacactgttaaaacaagatacttgttttactgaccttgaaagaaaaaaatcgtctacgccgtaaaactacgtaaaaaaccactaaaaaaatacaaatttctgctatttttaccttctttactctttccaaaatattaacacctgcacaagggagacccacatgacacatgcctgtgaggcggtgaaaacccgccataaggagacttcgcttattttcccggttcttgcgctggtagtgctgttcctttggggaagtagccagtcactaccagtggttattggcatcaatatccttgcacttattggtattttaagcagcgcatttagcgtggtccgtcatgccgatgtattagcgcaccgactcggcgaaccctacggatcgcttattttaagcctgtccgtcgttattcttgaggtgagtttaatttccgcgctgatggctaccggcgatgctgcgccaacgcttatgcgcgatacgctctactctattattatgattgtcaccgggggactggtcggtttttcgttgttgttgggcgggcgtaaattcgcaacgcaatatatgaatttatttgggattaagcagtatcttatcgcgctatttccgctggcgattattgtgctggtttttcccatggcattgccgcaagccaatttttctactggtcaggcattattggtcgcgttaatttccgccgcgatgtacggcgtatttttgttgattcaaaccaaaacgcaccagagcttatttatctatgaacatgaagatgaaggcgatgatgacaatccacaccacggtaaaccctccgcgcacagtagcggctggcatacggtctggttactcattcatttaattgcggtcattgccgttaccaaaatgaatgccagcccgctggaggcgttgctgaccagcatgaacgctccggtcgcctttaccggtttcctggtcgcgctgttaattctctcgccggaaggactgggcgcgctgaaggcggtactgaataatcaggttcagcgggcaatgaatctgttcttcggatcggtgttggcgacgatttcattaaccgtgccggtcgtcacgctcatcgcatgggcgacaggtaatgatctggtgtttggtttaggcgcgccggaaatggtagtgatggtggcctcgttagtgctgtgccatatttcgttctctaccggacgcaccaacgtgctaaacggcgcggcgtatctggctttatttgccgcctatctgatgacgatttttgcctgatataaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaataaaaacggggacgttaagcccccgtttttgtttttaacaattatcgatattacatatttgcgataatcgcgtcgccaaactcactacatttcagcagcttagcgccgtccatcaggcgttcaaagtcataggtcacggtcttcgcggcaatcgcgccttccatacctttaacaatcagatccgccgcttcgaaccactgcatgtggcgcagcatcatctccgcagacagaataatggagcctgggttgactttatcctggcccgcatatttcggcgcagtcccgtgagtcgcttcaaacaacgcgcattcgtcgccgatattcgcacccggtgcaataccgataccgccaacctgagccgccagggcatcggaaatatagtcaccgttcaggttcatacaggcgataacgtcgtattccgccggacgcaacaggatttgttgcaggaacgcatcggcgataacgtctttaaccacgatctctttacccgtgttcgggttcttaattttcagccacggaccgccgtcaataagctcaccgccgaactcgtcgcgcgccaactggtagccccagtctttaaacgcgccttcggtgaacttcatgatattgcctttatgtaccagcgtgacggaatcgcgatcgttggtaatagcgtattcaatcgccgcgcgaaccagacgtttagtgccttcttcagaacacggtttgataccgataccgcagtgctccgggaagcgaattttcttcacgcccatctcttcgcgcaggaacttgatcactttctcagcgtctgcagagtcagctttccattcaattccggcgtagatgtcttcagagttttcacggaagatgaccatatcggtcagctccggatgtttcaccggacttggcgtgccctgatagtaacgaacgggacgcagacaaacgtacaggtcaagctcctgacgcagggcaacgttcagagagcggataccgccgccaaccggcgtggtcaatggacctttaatcgctacgcggtagtcacgaattaaatcaagggtttcagcgggaagccagacatcctggccgtaaacctgtgtggatttttctccggtgtaaatttccatccaggaaattttacgctcgcctttataggctttctcgacggcggcatcgaccactttaagcatggctggagtgacatcaacaccgataccatcgccttcaataaacgggataatcggattctcaggaacgttgagtttgccgttttgcagggtgatcttcttaccttccaccggaacaactactttgctttccattcacctctccttcgagcgcttctggtttgctcgtctgtcatcgcgctgcatgtgcaatggcgtcctgctgcacgactgcgttagagcaattttttgttaatgttttgtaatgagcatgtcaatactaccctattgtttgccgccatgaaagacactcattattgcgctataatgcggcaattaataagttctgaaaacaccatgcaaaaaacttcttttagaaatcactacgttaagcgattcagctcacgacaagcatctaaatcacggaaagaaaaccagccaaaacgcgtggttttgttcaataaaccttacgatgtgttgccgcagttcacggatgaagcaggtcgccgcacgttaaaagattttattcctgtgcaaggcgtttatgccgcaggccgcctggaccgcgacagcgaagggcttttggtgctgactaatgacggcgcgctgcaggcgcgcctcacgcaaccgggcaaacgcaccggcaagatttactatgttcaggtagaaggcatcccggataatgcagcgctgcaggcgcttcgtactggcgtcacgctcaacgatggccctaccctgcccgccggtattgagattgtcgcggagcctgactggctgtggccgcgcaccccgccgattcgcgaacggaagaatattcccaccagttggctaaaagtcaccttatatgaaggccgcaaccaccaggtaagacgcatgacagcgcatgtcggtcatcccactctacgattaattcgttacagcatgggcgactacacgctcaacggcctcgataatggacagtggtgcgagatcgcacaggagaaagacagatgaaacggcttctcattgcttttgctttattaacaccgttatccgttaatgcggccagcttcgactgccagaaagcgcaggctgcggatgaaaaggctatctgcgcgcacctgacgctgaatgataaagacgtggaaatgcacaccaaatatcagtttctgaaagggttgttcgcgatgggcagtcgcggcgcgctgcaggacgcccagcagagctggcttaaacagcgtcagcagtgcaaggccgacgtcacctgcctgacaaaagcttataacgagcgtctgaaacagcttgacgcgatctatgaccacattgataaaccgctttaataaggatgcctatgttcaagccgcacgtgaccgttgcctgcatcgtacatgccgaagataaatttctggtggtggaagagaccatcaacggtaaatcgttatggaatcaacctgccggacacctggaggcagatgaaacgctggcgcaggccgccgcgcgagaactgtgggaagagactggcatcacggcgcaaccacagtattttatccgtatgcatcagtggattgcgccggataaaaccccgttcctgcgctttttattcgctatcaagcttgatcatatttgcgcgaccgccccccatgacaatgacatcgattgctgccgttgggtgagcgccgacgagattctgaacgcgccgaatttacgttctccgctggtggctgaaagcattcgcagttatcaaacgggacaacgttaccccttatctatagtgggcgaatttaactggccgtttacagagggtgtcaagtaaagggctgcgtgatagaatacgccgccttgaagttcaatgtcgcgagtattccaatgtcagaaagcccaaaaaaagtgatcgtcggcatgtccggcggtgtcgattcctccgtttccgcctggctgttgcaacaacagggttatcaggtagaaggcctgttcatgaagaactgggaagaggacgatggtgaggaatactgcaccgcggcagccgatctggctgacgcgcaggccgtgtgcgacaagcttggcattgaactgcataccgttaattttgccgcagaatattgggataacgtctttgaactgttccttgaagagtacaaagcgggccgtacgccgaatccggatattctgtgcaataaagagatcaaatttaaagccttccttgaatttgccgcagaagatttaggcgccgactatatcgccaccggtcactacgttcgccgcgcggatgtaaacggcaaaagccggttgttgcgcgggctcgacggtaacaaagatcagagctacttcctctatacgcttggccatgagcagattgcgcaaagtctgttcccggttggcgagctggaaaaaccgcaggtgcgtaaaatcgccgaagatttggggctggtaaccgccaagaaaaaagattctaccggtatctgctttatcggcgagcgcaaattccgcgactttttagggcgctatctgcctgcgcagccggggaaaatcattactgttgacggcgatgaaatcggcgagcatcagggtctgatgtatcatacgctcggtcagcgtaaagggctgggaattggcggcaccaaagacggtagcgaagacccctggtatgtggtggataaagacgttgaaaacaatgtgttaattgtcgcccaggggcatgagcacccacgcctgatgtcggtaggcctcatcgcccagcagctacattgggtcgatcgcgaaccgttcaccggcaccctgcgctgtacggtaaaaacccgctaccgccagaccgatattccgtgcacgattaacgcgctggatgacgatcgtatcgaggtcatttttgacgagccggttgccgccgttacgccgggccagtccgctgtcttttacagcggagaagtctgcctgggcggcggcattatcgagcagcgactgccgctgacggtctgattattcaatacacaacaccattcaagtcacctcaaagcggcttaaaagatgaagtgtattttatttgatacaaggaagcagtgattgtggcaaagaattattatgacatcaccctcgcgctgtctggcatttgccagtcggcacgcctggtgcaacaactggcgcaccagggacactgtgatgccgacgcgttgcacgtttcactcaacagtgtcattgatatgaatcccagttctactctgggcgtgttcggcggcagcgaagctaacctgcgtcttggtctggaaacactgctcggcgtgctgaatgccagcagccgacaaggacttaacgccgaactgacgcgttatacgcttagcctgatggtgctggagcgcaagctgtcatccgccaaaggcgcgttgaatacgttaggcgatcgcattaacggcctgcagcgccagcttgaccattttgatttacagtcagacacgttaatgagcgccatggcgggcatctacgtggatgtgattagcccattgggcccgcgcattcaggtgacgggctccccggccgttctgcaaagtccgcaggtgcaggccaaagtccgcgcctcgctactggcaggcatccgtgcagccgtgctctggcatcaggtaggcggtggtcgcctacagcttatgttttctcgtcatcgcctgacgactcaggcaaaacaaattcttgcttatttaaccccggagttatgatctatggaattatcctcactgaccgccgtttcccctgtcgatggacgctacggcgataaagtcagcgcgctgcgcggaatttttagcgaatacggtttgctgaaatttcgtgtacaagtcgaagtacgttggctgcagaaattagccgcgcacgcagcgatcaaggaagttcctgcttttgctgccgacgcaaacggttacctggatacgcttgtggcaaacttcaatgaagaagatgccgcgcgcattaaaaccattgagcgcaccacgaatcacgatgtgaaagcggttgagtattttctgaaagaaaaagccgccgcgatcccggcgctacatgacgtttccgaatttatccactttgcctgcacctctgaggatattaacaacctgtcgcacgcgttaatgctcaaaactgcgcgcgatgaagtgatcctgccttactggcgtcaggtgattaacgcggttaaagatctcgccacgcagtatcgcgatattcctctgctctcccgcacccacggccagccggcaacaccttccactctgggtaaagagatggcgaacgtggcgtatcggatggagcgtcagttccgccagctcaatcaggtggagatcctcggtaaaattaacggcgccgtaggcaactataacgcgcatatcgccgcctatccggaagttgactggcatcagttcagcgaagagttcgtcacctcgctgggcatccagtggaacccttacaccacccagattgaaccgcatgattatattgcggaactgtttgactgtatcgcgcgctttaacaccatcctgatcgatttcgatcgcgatgtctggggctatattgcgttgaaccatttcaaacagaaaaccatcgccggagagatcggttcttctaccatgccgcataaagttaaccccattgactttgaaaactcagaaggcaacctcggtctgtctaatgcagtgttgcaccatctggcaaacaaactgccggtttcccgctggcagcgcgatctgaccgactcaaccgtcctgcgtaacctgggtgtcggcatcggctatgcgcttatcgcttatcagtcgaccctgaagggcgtcagcaagctggaagtgaaccgcgatcatctgcttgacgaactggatcacaactgggaagtattagccgaaccgatccagaccgtcatgcgccgctatggcattgaaaaaccatatgaaaaactgaaagagttgacccgtggcaagcgtgtcgatgccgaaggaatgaaacagcttattgatagtctggccctgccggaagcagaaaaaacgcgccttaaagccatgacgccggcaaattatatcggtcgcgctgtgaatctggtcgacgaacttaaataatgtgtgcctcaccctcttttcttcagaaagagggtgactatttgtctggtttattaactgtttatccccaaagcaccataatcaacgctagactgttcttattgttaacacaagggagaagagatgatgcgcgtactggttgtagaggataatgcattattacgccaccacctgaaggttcagctccaggattcaggtcaccaggtcgatgccgcagaagatgccagggaagctgattactaccttaatgaacaccttccggatatcgctattgtcgatttaggtctgccggatgaagacggcctttccttaatacgccgctggcgcagcagtgatgtttcactgccggttctggtgttaaccgcgcgcgaaggctggcaggataaagtcgaggttctcagctccggggccgatgactacgtgacgaagccattccacatcgaagaggtaatggcgcgtatgcaggcgttaatgcgccgtaatagcggtctggcctcccaggtgatcaacatctcgcctttccaggtggatctctcacgccgggaattatccgtcaatgaagaggtcatcaaactcacggcgttcgaatacaccattatggaaacgcttatccgtaacaacggtaaagtggtcagcaaagattctctgatgcttcagctgtatccggatgcggaactgcgggaaagtcataccattgatgttctcatggggcgtctgcggaaaaaaatacaggcccagtatccgcacgatgtcattaccaccgtacgcggacaaggatatctttttgaattgcgctaatgaataaatttgctcgccattttctgccgctgtcgctgcgggttcgttttttgctggcgacagccggcgtcgtgctggtgctttctctggcatatggcatagtggcgctggtcggctatagcgtaagttttgataaaaccacgtttcgtctgctgcgcggcgaaagcaacctgttttataccctcgccaaatgggaaaataataaaatcagcgttgagctgcctgaaaatctggacatgcaaagcccgaccatgacgctgatttacgatgaaacgggcaaattattatggacgcagcgcaacatcccctggctgattaaaagcattcaaccggaatggttaaaaacgaacggcttccatgaaattgaaaccaacgtagacgccaccagcacgctgttgagcgaggaccattccgcgcaggaaaaactcaaagaagtacgtgaagatgacgatgatgcggagatgacccactcggtagcggtaaatatttatcctgccacgacgcggatgccgcagttaaccatcgtggtggtcgataccattccgatagagctaaaacgctcctatatggtgtggagctggttcgtatacgtgctggccgccaatttactgttagtcattcctttactgtggatcgccgcctggtggagcttacgccctatcgaggcgctggcgcgggaagtccgcgaacttgaagatcatcaccgcgaaatgctcaatccggagacgacgcgtgagctgaccagccttgtgcgcaaccttaatcaactgctcaaaagcgagcgcgaacgttataacaaataccgcacgaccctaaccgacctgacgcacagtttaaaaacgccgctcgcggttttgcagagtacgttacgctctttacgcaacgaaaagatgagcgtcagcaaagctgaaccggtgatgctggaacagatcagtcggatttcccagcagatcggctattatctgcatcgcgccagtatgcgcggtagcggcgtgttgttaagccgcgaactgcatcccgtcgcgccgttgttagataacctgatctccgcgctcaataaagtttatcagcgtaaaggggtgaatatcagtatggatatttcaccagagatcagttttgtcggcgagcaaaacgactttgtcgaagtaatgggcaacgtactggacaacgcttgtaaatattgtctggagtttgtcgagatttcggctcgccagaccgacgatcatttgcatattttcgtcgaagatgacggcccaggcataccccacagcaaacgttccctggtgtttgatcgcggtcagcgcgccgataccctacgaccaggacaaggcgtggggctggctgtcgcgcgcgagattacggaacaatacgccgggcagatcattgccagcgacagtctgctcggtggcgcccgtatggaggtcgtttttggccgacagcatcccacacagaaagaggaataaacatttctgtgcgttcttccacgcatctcgttaagcatccgttataatcggtgtcagataccagcctgcggatacttaacatggaataccaattaactcttaactggcccgactttcttgaacgccactggcaaaaacgcccggtggtcttaaaacgtgggtttaccaactttattgatccgctctcgccggatgagctggcggggctggcgatggaaagcgaaatcgacagccgtctcgttagccatcaggatggcaaatggcaggtcagccatggccctttcgaaagctacgatcatctgggtgagagcaactggtcgctgctggtacaggcggtaaaccactggcatgaacccaccgccgcgctgatgcgcccgttccgcgctctgccggactggcgtatcgacgatctgatgatctccttttccgttcccggtggcggcgttggcccgcatctggatcagtatgatgtgtttattatccagggaaccggtcgccgtcgctggcgcgtgggcgaaaagctgcaaatgcgtcagcactgcccgcatcccgacctgttacaagtcgatccgttcgaggccattattgacgaagagctggagccgggcgacattctgtatattccgcctggattcccgcatgaagggtatgcgctggaaaacgccatgaactattcagtcggttttcgcgcgcccaatagccgtgagctgatcagcggttttgccgattacgtcctgcaacgggatctgggcaacacatactacagcgatccggatatgccgtcccgcaaacatccggcggatatcctgccgcaggagatggataaactgcgtaatatgatgctcgatttgatcaatcagcccgcgcatttccaacagtggcttggcgagtttatctctcagtcacgccacgaactggatattgcgccgccggagccgccgtatcagccagacgaaatttacgatgccttaaagcaaggcgaggcattagtacgtctcggcgggcttcgcgtattgcgtatcggcgatgaagtctatgcgaatggcgaaaaaatagactctccgcatcgccccgctctggaagcgctcaccagtcatattgtactgaccgctgaaaacttcggcgatgcgctggaagacccttccttcctcgcgatgctggcggcgctggtgaatagcggatactggtttttcgaaggataagaacatcgcaatgcccggcgaccgccgggctgacgcaaactatccacaacgatcgccgccaggtttggcgaaatcgttatattgcggatcgcccggataaatcgagtgggccattcgatggcgaaatgacatttgccgatagcgccgcgcctgcgcgttatctccaagaccttcggcaatattagccagttgctgtaatcgttcatactgcatctttgctggataagctacggcatcaagcgtaaaggcgcgttccgcaaagtcttttgcttgttcaagctgttgattattcttataaagcagcgaaataccatacaacaccatggatacgtcggactgccgacgtttatattcttccagcaatgggagatagggggaggtactgtccaggtcgatgttttcgggcaaataaaagcgtaatcgtgatattaccgtcgccattggcgttaaacggctctggtaatacgcgataagtttaaggtagagatctttcgcttccttataatgatggccctgtgcataaaagccagcaagattattgctgtcaaccgtcatttcgccgaattcggtgccataaagcgtttgctcaatttttagcgcctgacttagcgcattaatcgcctcgctaatatgccctgcattataagcaatatccgctttctgctgcaaaaaagaggcgacgcgctcacgattatcccaggttttatcccgtaaaataacgctcagccactgccgctccgctgcgtctatcttcgccaaataataggctttacgcgcactatcacattcgacatcccgctcttccagcgcatcagaataagcgtcgcgcatcctgtttaaggtataaaccaacgcttccgtcgatgtctttttgtctttaagacgccacgttaatgcctgctcttgccaggctatccgctgacggtaatcaaccttgatctcgtatcgccactgctctgtcggtgaatactctatatggcgatcgtcaccgtaaacataaaaggccgccaggtgttcaaacatatcggcccgatcgcccggataagtgcccgccggaaatgttttcatgattgcccgcgctcgcagcagcatttgcggcgttaactccggtttacccagccattgataaatatcgctttgtaatagcaggctacgaacaagctgtattgagcgtttgccatattgccgcgaggccagcctcaccgcatcatcaataaacgtcatgcaggtttcatcgccggtcataaaacatgctgcagattgttgctggcgctgggaccaggaaggcgtatattcggcgctccaggcagaaaaatttatggcggaaaatatcccgccataaataataaaacgcttcaccacaatgtgtaacattcgctactggccgcgcttacccgtcagctccgcgatacgtacaatcacctgtaccgctttttccatcccctccagcgtcacaaactcatgtttaccatgatagttatatccgccggtaaagagattaggacacggcaggcccataaacgacagttgcgccccgtctgtaccgccgcgaattggtttcatctccggcgtaatatgacagtcgcgcatggcctgctgggcgatatcgagaatatgcggatgctcaaccactttttcgcgcatattgtaataactgtcttcaatcaccagttcgatatagcagtccggatgcagccccttgccgacttttttggcaatctccatcattttgcgtttacgcgcttcaaactgcttacggtcgaaatcgcgaatgatgtagtgcatttcggcccggtcaacggtgcctttcatgctggccagatgataaaacccttcgtaaccttcagtggtttcaggcgcttcatccgccggcacttccgcgtgaatcctcgccgccaacgacagcgcattgaccatcacgcctttcgccgtaccaggatgcacgttattgccgacgattttgatattcaccgaggcggcattgaagttttcaaactccagttctcccacgccgccgccgtcgaccgtataggcccactgcgcgccaaattcctcaacatcgaagtgcttcgcgcctttccctacctcttcgtcaggcgtaaacgccactttaatttcgccgtggggaataggattacctttcagcaccgccagcgcggtcatgatctccgcaacaccggctttatcgtccgcgcccagcaatgtcttaccatcggtagtaatcagcgtctgtcccagtaattgatgcagtaccgggaacatcacgggtgacaacacctcatcgccaatccctaatgctatatcgccgccgcgataattctcgacaatctgcgggttaacgtttttaccgctgaaatccggagaggtatccacatgggagataaaaccaatggcgggaatatccccctcaacattggccgggagcgtcgccatcaacgtccctttttcacttaatgtaatgttaaccagccccatctcttcgagctgctgtttgagcaaacgtagtaacttccactgcccctcagtgctgggaacctgccgaacacccgactttgattgggtatccagcgatacgtagtgtaaaaaacgctcaagtagtttatccatgcagtcaccctcacttttcgtgacaacattattaataagcaagaaaagacaaatattgcgtcaggtcacttttatccctgcaaacaagaatatttcactttgacacgctttctgactataaagctaagtcagtaattcgcaacaaggattggcgatcacggtggtttgccgtagaatgaccgccctcattaagagtgattaaggtggttaaccacaaaccccgcagcggtcagccatccgttgcgtttacatgggacagagtaagaaattgaataaacaaccgcgttcgctttcaccgctggtgcttttgtcgggaattagcaaaagtttcgatggcaaagaggtcatttcacagctggatttgaccattaacaatggcgaattcctcacgctgcttggcccttccggctgcggtaaaacaaccgttcttcgcctgattgccggcctggaaaccgttgatgccgggcatatcatgttggataaccaggatatcacccacgttcccgccgaaaatcgttatgtaaataccgtatttcaaagctacgctttatttccgcatatgacggtgtttgaaaatgtcgcgtttggcttacgaatgcaaaaaacaccagccgccgagatagcgcctcgcgtgaccgatgcgctgcgtatggtgcagcttgaagagtttgcacaacgtaaaccgcaccagctttccggcggacagcagcagcgtgtggctatcgctcgcgcggtggtgaataaacctcgcctgttattactggacgaatcgctctccgcgctggactataaattgcgcaaacaaatgcagaacgagcttaaagcattacagcgtaaactcggtatcacgtttgtttttgtcactcacgatcaggaagaagcgctcaccatgtccgatcgtatcgtggtaatgcgtaatggcgtgattgagcaagacggcacgccgcgtgaaatctatgaagagccaaaaaacctgtttgtcgccggttttatcggcgaaattaaccgctttgacgcaaccgtcattgaacggcttgatgaacagcgcgtccgcgccagcgtagaaggtcgggagtgcaatatatacgtcaatttcgctgtcgaactgggccaaaaactgaacgtcctgctgcgaccggaagatctacgcgtcgaagagatcaacgatgataaccacatcgaagggcttatcggctacgtgcgcgagcgcaattacaaaggtatgacgctggagtcggtggttgaactggaaaatggcaaaatggtgatggtcagcgaattcttcaacgaagacgatcctgacttcgaccattcacttgaccaaaaaatggccattagttgggtagaaagctgggaggtcgtactggctgatgaagaacacaagtaaattccagaatgtagtgattgtcactatcgtcggttggcttgtgttgtttgtttttctgcccaacctgatgatcattggcaccagctttctgacccgtgacgacgccagtttcgtcaagatggtctttacgctggataactacgcacgcctgctcgatccgctctattttgaagtgctcctgcactctctgaatatggcgctgatcgccaccctctcctgcctggtgctgggctatcctttcgcctggtttctggcgaagttaccggaaaagatacgtccgttattgctgtttttgctgattgttcctttctggaccaactcactgatccgcatctatgggctaaaaatattcctgagcactaaaggttatctcaatgaattcctgctgtggctgggcgtgattgatacgccgattcgcatcatgttcaccccgagcgccgttattatcggcctggtttacattttgctgccgtttatggtcatgccgctctactccagcattgagaagctcgacaaaccgctactggaggccgctcgcgatctcggtgccagtaaaatgcaaacgttcatccgcatcattattccattaaccatgccgggcattgtcgccggttgcctgctcgtgatgctaccggcaatgggcctgttctacgtctccgatttaatgggtggcgcgaaaaacctgctgattggtaacgtcattaaggtacagttcctgaatattcgcgactggccgtttggcgcggctaccagcattacgctgaccattgtgatgggactcatgctgttgatttactggcgggcttcccgcttattgaataagaaggtgagtgatataagcgattaattgcgcaacgctaacaaatccacacgcatccaggcatgaagtttattcaagggtaaacttcatgcctccggcataaaaaacgcatgaaagaagttgccgccagtattgcaaatctacaacatcatccgcggtaggccttcttttatttttacctgtagcgacgctatcgcagacagtaatgcgtttatacgcgaagctctcaggttttatactgattgccagtctcttttaaaaattatattacatccgatgcgcccgcagttgagataaaaagagttgatttaatcaattatgtagtcatttttactccagtataagtgagattaatatgccgattactatagggaatggttttttaaaaagtgaaatccttaccaactccccaaggaatacgaaagaagcatggtggaaagttttatgggaaaaaattaaagacttctttttttctactggcaaagcaaaagcggaccgttgtctacatgagatgttgtttgccgatcgcacccccacacgagagcgatttacagagattttttttgagttaaaagagttagcctgcgcatcgcaaagagatagatttcaggttcataatcctcatgaaaatgatgacacgattattcttcgcatcatggatcaaaacgaagaaaacgaattgttacgtatcactcaaaataccgatacctttagctgtgaagtcatggggaatgcttattttttaataaaagatcgccccgatattttaaaaccgcatccacaaatgacggccatgattaatagaagatatagcgaaatcgtagattaccccctcccttcgacattatgtctcaaccctgctggcgcgccgacattatcggttccattagacaacatagaggggtatttatattctgaatggagaaaaggaaatttagatgagtggaaaacgcaagaaaaggcaacctacctggcagcgaaaattcagtctgggattgaaaagacaacgcgcattttacagcatgcgaatatatccgaaagtactcagcaaaacgcatttttagaaacaatgacgatgtgtggcttaaaacagcttgaaataccaccaccacatacccacatacctattgaaaaaatggtagaagaggttttactggcggataagacgtttcaggcgttccttgtaacggatcccagcgccagcctaagcatgttagctgagatagtcgaagccatctctgatcaggtttttcacgccatttttagaatagccccccagtctatacaaaaaatggcggaagaacagttaaccacgctacacgttcgctcagaacaacaaagcggctatttatgttgttttttataaaatcagacgacgctttctcagacgtcacgttcagggtttactcacgtacttcatgtttgcctacagagtaacctcttgcctggcgcaataatgccgcatatgaccggatcggatgagaatagtcatttaaatggcctttttttcccgctcgtctggcaatttgttgtaaaattcgcggcttcaagcggcagcttgcttcttcctggctgctgataaccgcgagacgttttggagagattttggagaagagaaaaaattgatcattttcaatactctaaaagcaccccatcctctgaataagaaggtggaacttgaatgatcggtcggctgctccgtggcggtttcatgactgccatctatgcgtatctgtatattcccatcattattctgatcgtgaactccttcaacagttcgcggttcggcattaactggcagggctttaccactaaatggtacgaactactggtcaataacgacagtctgttacaggccgctcaacattcactgacgatggcgattttctcagcgaccttcgccacgttgattggctcgttaaccgcggtagcgctttatcgctaccgctttcgcgggaagccattcgtcagcgggatgctgtttgtagtaatgatgtcgccggatatcgtgatggcgatctccctgctggtgctgtttatgttactcggcattcaactgggcttttggtcgttgctgttctcgcacatcacctttagcctgccgtttgtggtcgtcacggtctattcgcgcctgaaaggctttgatgtcagaatgctggaagccgcaaaagacctgggggccagtgaggtaacgattttacgcaaaatcattctgccgctggcgatgccggcggtggcggcgggctggttgctgagctttacgttgtcgatggacgatgtagtagtctcgtcgtttgtcaccgggccgggctatgaaattttacccttaaagatttattccatggtaaaagtcggcgtttcaccagaagtgaacgcgctggcgaccgttttattggtgctgtctctggtaatggtcattgccagccagcttattgctcgtgataaaaccaagggccgataaggcccgtaattcaggggacgttaaatgaaaaaatggtcacgccacctgctcgcggcaggcgccctggcgctgggtatgagtgccgctcatgcctccgacaacgacacgctctatttctataactggactgagtatgtaccgccgggcctgctggaacagttcactaaagagacaggcattaaggtgatttattcgacctacgagtcgaacgaaaccatgtatgccaaactcaaaacctataaagatggcgcgtatgacctggttgttccttctacatactatgtcgacaaaatgcgcaaagaaggcatgatccagaagatcgataagtcgaaattaaccaatttccacaacctcgatccggaaatgctcaacaaaccgtttgaccccaacaacgattattctgttccgtatatctggggcgcaacggcgattggcgtgaacagcgatgctatcgatccaaaaaccattaccagctgggctgatttgtggaaaccggaatataaaaacagcctgcttttaaccgacgatgcgcgagaagtcttccagatggcgctgcgcaagctaggttattccggtaacactaccgatcctaaagagatcgaagcggcatatgaagagttgaaaaaactgatgccgaacgtagcggccttcaactccgataatccggcgaatccgtatatggaaggggaagtcaatctggggatggtgtggaacggttcggccttcgttgctcgtcaggctggcacgccgctggaggtcgtctggccgaaagaaggcggtattttctggatggatagcctggctattccggcaaacgcgaaaaataaagagggcgcgctgaagctaatcaacttcctgctgcgtcctgacgtcgcgaaagaggtggcagaaaccatcggctaccctacccccaacctggcggcgcgtaagctgttaagcccggaggtcgccaatgataagtcgctctatccggatgcgcaaaccatcagcaaaggcgagtggcaaaacgatgtcggcgacgccagcgccatttatgaagagtattatcagaagctaaaagcaggacgctaattcagccaaagcgcctgtcgggcctacagatgaacgtaacgtgaaatgtaggccggataaggcgttaccgggcaaacggcactacagccctttcaggaatttatcaacaaattccggcacaacctggcttgccgggccgtagtgcttctcttcaaactcgctgccgacctggcttggctcaagattcagttccaccgtatgtgcgccgtgcagttttgcttcatgcacaaaacccgcagccggatagacatgaccggatgtgccaatggcgataaaaatatccgccatcgacagcgccatataaatttcatccatgccaagcggcatctcgccaaaccacaccacgtgcggacgtagcggcgccgggaactggcagcagtgacatttatcttccggcatcacatcgccgttccattccagaatctggccgctttgcgaacagcgcaccttcaacagctcgccatgcatatgaatgatgttgcggttgcccgcgcgttcatgcaaattgtcgatgttttgcgtcaccagcaaaaagcgatcgccaagcgcttcttcaagcttcgctaacgccagatgcgccgcattgggttgtatttccggctgttgaagctgctgacggcgggcattataaaatgtctgcaccagccccggattacgggcgaatccttccggcgttgccacgtcttcaacccgatgctcttcccaaaggccatccgccgcgcgaaacgtacgaataccagactctgcagaaattcctgcacctgtaaggactaatactcttgggttttccatcatttccggcaccactctgtctctgaaaaagatccgctggcgcagacgttcacgcaacagacgtttatttttacgaaagcggcttaatcgatgaaaccgacgcgactgcataacaacctctttttttgattagtcggtaagatgtaaaaaagcagcaccgcgcatcccacctgcatccccatgccgcgcacgctcaatgcgcggcgcgcgggcaacagggaggagatggcgcggcagtctttccgccagttgcgttgttattgccgtaaagttcgatagtccgccgccgatcaccaataaatcgggatcgacaatcgtcagtatattccccagacaaaccgccagtaaatccagatagcgctcaacatgcgcgtgcgcctgctcatcaccctgctcccacaacgcgataatctccggcgcctgcagcgattgatcataataatgttgatatagccacgcaaacccgcgcccggacagataattctcaatgcagcccatctggccgcatccacaacggcggagaggaaaatcaaaccccatcaacgttagcgcgtcaaccggcaaacgcatatggccaaactcgccggtgatatagctctgaccggtaatcggcttcccgtttagcaccaggccgccgccgccggtgccgaggataagccccataaccaaaggatattgcgtgaattcatcatcccaggcttcggacaaggcaaaacagttagcgtcattgtccagacgcacatcgcgatccagtcgggcgctgagatcggcgcgcaacggcttaccgctggctgccgggacattcgcggcgtacagcgtgccgtcttcagtttccggcataccgggtatgccaatccctaccgacccttttacgccaaatcgctggtcggcttccgcgaccagttcgcacacggcgtctaaaaaggcgctatagctggtatggggcgtgggaacccgtttttcccactgcagccgccgcgttgagtcaaatacgcctaacgcaatctttgttccgccaatgtcaaacccgtaatacatcgccgctccttgtttttatattccgcgattactggccgctcaatactcgcgcagggtcaatgttgctcgcccgccgcgccggataccagctcgccagtaagcttaacaacaacgccgtgaccagtacgtaaacaacgtccagccaatgtaattcggatggcaggaagtcgataaaatagatatcgccggacaaaaactgatgcccgatctccttttcaatcccattaataatggcggtaagctgaagcgaaacgacaacgccgatcgccacgccaatcaagctgcccagcaagcccgccagtagtccgtaccagacgaaaatggcacgaatcaaaccatctttcgcccccagcgttcttaataccgcaatgtcgccgcttttgtcttttaccgccatcactaaggtggaaacgatattaaaacaggccacgccgatcaccagaatcatcgccagatacataatggcgcgaatcatctggatatcgcgatacatatagccgtaggtgccgatccagctcttaatgtagacatagctgttagtcacttcacccgcatcacgcaccagtttgttcgcattaaacacgtcgtggactttaagcgcgataccggaaacgctggaccccatatccagatactgctgcgcatcctcaagcgggatcatggcgaagctgtgatcgagctggccgctcagttgcagaatcccgatgacatgcaaacgcacgcgtttgggctggagcagcttatggtcggcattcgcattggggatcatgatggacacccagtcgccctgtttcacgttcagcgcatcggcgacgcctttaccgataatgatctgctgctcgcccgctttgaaatgatcccaggcgtgattttgcacaaatgacggtaacgcgctaagctgctgctcttgcttaggatcgacgcctttaacctgaatggcgcgcaaattcgccccgctctctaccaggccggtaaaattgatatacggcgcggcggcggcaatgcccggcaccttctgcacttttgccagcgcttcacgccagttggtccacggctgattgaccgcttcaatctccccgtgtggaaccaccgccagaatacggttattcaactcgcgttcgaaaccgttcatcgcgcttaaaccgacaatcaacaccgccacgcccagcgcgataccgatggtagaaatgacggaaatgagcgaaaccataccgccgcgccgccgtccacggctgaaacgcaagccaattaacaatgataaaggcgacgccattactcagcccccatcaggctcagttccgctgtcaggcggccatcgcgcatctcaagctggcggctcatacgtttcgccagttgcaaatcgtgagtcaccaccagaaacgcggttccctgcagacgatttaactcgcccagaagctcaaaaatactgtcggcattacgcgcatccagattaccggtcggctcatccgccagtaccagacgcgggttattcaccaacgcgcgcgctatcgcgacacgctggcgctcaccgccggaaagttccgaaggtcgatgggttgcgcgatgctccagccctacagcatgcaacatttctcgcgcccgagcgtcaatctccgccggtttctttttgccaatcaataatggcatcgccacgttttccagcgccgtaaaatccggcaggagatgatgaaactgatagataaaccccagtttctggttacgtaattccgcttttgccgcagaagagagtttgctcatcggctggccgctaaaaatcacatcgccagaggtaggcgtatccagcccgcctaacagatgcagcaacgtacttttacccgaaccggaactgccgacgatcgccatcatttcgccttcgccgatactgaagctgacatcgtgcaacacgtcggtttgtacggtgccttcctgatagcgtttgcacaggttgtcgcattgcaacaggatcttattcataacgtaaagcctcagcgggttgagtggcggcagcgcgccaggaaggataaagcgtagaaagcagcgcgatggccattgccaccagcgcgataacgatcacctgtaacggctctatcgccacgggcaacgcagcgccatccagaaacgcgccgatgatcggcatcaggttattcagttggctggcaagcaatgcgcccagcgcggcgcccaacagcgcgccgataatcccggcgctggcgccctgcaccataaagaccatcataatttgtcgcggcgtcagcccttgagtttgtaaaatcgccacttcgccctgcttctccatgaccatcagacccaacgaagtaataatgttaaaagccgcgaccgccacgatgaggctcagcaacaatcccatcatgttcttttccatgcgcacagcctggaacaactcgcctttacgttcgcgccagtcctgccacttcgtgccttgcggcagcgtctgttggctgagagtatcgacttgcagcggttcatccagccacagacgccagccggtaatattgcctgccggatagcgcattaaacgcgacgcgtcctgaatattgaccagcatttcatagccatcgacctcgctattggcggcaaatgtgccaatcaccgtaaacagacgctggctgggcaggcgtcccattggcgtaaactggctggcagatggcaccattagccgaatctgatcgccgcggttgacccctaactgtccggcgagctgctcgccgaggatgacattatacttacccggctgtaattcgctttgcttcacattgaccagatacggcgttaacggatctttttgcgccggatcgatacccaacatcacgccaaccgcaacgctacgcgcgctttgcagtacgacatcgcccgtcgtcagcggcgcaatacggttaacgccttgcagattcaccgctttttccggcatctgattcgggttaagagaaccatgttcagcagagaggatggcctgaggcatcaaaccaagaatgttattttgcagttcgcgctcaaaaccgttcatcaccgacaataccgtgaccagcgccatcacccccagggtaatgccgatagtggaaagccaggaaacgaagcgaccgaagcgatctgctgcacgcccgcgcatgtaacgcaggccgatgaataaagcgacaggttgatacatgtaatccgtctggttgctgttagcaaagtcccgagtatataagcgaaagcggaatgcgtaaatgtctgaaccgtaagagttcgtcagcgttattctgaaaaaggccgacaaatcaagtcacttacatgttcatactttacctgttcggcgtgttatccggcggattcaatttgctaataaacaacgatcgcggataataaagaacattgcttatcagtcatatgcccctgaatacctgagtccttcatgctgtcctggcgcgcagccaaccatgaagcagcctgaagggtgacgcgtagagtgcggcgtaaaacaaaaagagatactgacaaccgttatgcctgaaaaacaacgttacacgctgccgacaaaagcgggcgatcagcgccagttgggcgaacttaccggtgccgcctgcgctacgctggtggcggagatagctgaacgccatgccggtccggtggtactcatagcgcctgacatgcaaaatgctctgcgattgcatgatgaaatccgccagtttaccgatcagatggtcatgaacctggcggactgggaaacgctaccgtatgacagcttctccccgcatcaggaaattatctcttcgcgcctgtccacgctctaccagttgccgtcaatgcagcgcggcgtcttgattgtaccggtaaacaccctgatgcagcgcgtttgtcagcatagctatctgcatggtcatgcgctggtgatgaaaaaaggccagcggctgtcccgcgacgctctgcgcgcgcagcttgacagcgccggttatcggcatgtcgatcaggtgatggagcatggcgaatacgcgacgcgcggcgcgctgttggatctctttccgatgggcagcgaacagccttatcgcctcgacttttttgatgatgaaattgacagcctgcgtctgtttgacgcggatacccagcgtacgctggaggaggttgaggccatcaatttgttgcccgcgcacgaatttcctaccgacaaagccgctattgagcttttccgtagccagtggcgcgatacctttgaggtaaaacgcgacgccgagcacatctatcagcaggttagcaaaggcactctgcccgccgggatcgaatactggcagccgctctttttcagcgaaccgttaccgccattatttagctatttccccgccaatactctggtggtgaataccggctcgctggaaaccagcgccgaacgctttcaggccgatacgctggcgcgttttgaaaatcgtggcgtcgatcctatgcgcccgcttttgccgccggaagccctctggctacgggtggatgggctcttttccgagcttaaacgctggcctcgcctccagcttaaaaccgaccatctgccggaaaaagccgccaataccaatctcggtttccagaaattaccggatttggctatccaggcacagcagaaagcgccgctggacgcgctgcgtaagttcctcgaatctttcagcggtccggtgattttttcggtggaaagcgaaggacgccgcgaagctctgggagagctcctggctcgcataaaaatcgcgccgaagcgaatattacgcctggacgaggcgcaggatgcgggacgctatctgatgattggcgccgcagaacatggctttatcgacacccaacgcaatctggcgctgatttgtgaaagcgatcttttgggtgagcgggtggcgcgtcgccgcctggattcccgccgcacgatcaacccggatacgttgattcgtaacctggcggagctccacgtcggtcaaccggtagtgcatctggagcacggcgtcggacgctatgccggcatgaccactctggaggctggcggcatcaagggtgaatatctgatgctcacttacgccaatgacgccaaactgtatgtgccggtctcctcattgcatctgattagccgctatgccggcggcgcggaagaaagtgcgccgctgcataaactgggcggcgacgcctggtcgcgcgcccggcagaaagcggcggaaaaagtgcgcgatgtcgcagcggaactgttggatatttatgcgcaacgagcggcaaaagagggttttgcctttaagcatgatcgtgagcagtatcagttattctgcgacagcttcccgtttgaaacgacgcccgatcaggcacaggcgattaacgccgtattgagcgatatgtgccaaccgctggcgatggacaggctggtgtgcggcgacgtcggcttcggcaaaaccgaagtggcgatgcgcgccgcgttcctggcggtggaaaaccataaacaggtggcggtactggtgccgactacgctgctggcgcagcaacactatgacaacttccgcgaccgtttcgccaactggccggtacgcattgagatgctgtcccgctttcgcagcgccaaagagcagacgcaaatcctggcggaagccgccgaaggtaagatcgatattctgatcggtacgcataaactgctacaaagcgatgtgaagctacgcgacctcggcctgctgattgtcgatgaagagcaccgtttcggcgtgcgccacaaagagcgaattaaggcgatgcgcgccgatgtcgatattctgacgctcacggcgacgccgatcccgcggacgctgaatatggcgatgagcggtatgcgcgatctctccattatcgccactccccctgcccgtcgtctggcggtaaaaacctttgtccgcgagtatgatagcctggtggtaagggaagcgattctgcgtgaaatcctgcgcggcggtcaggtttactatttgtacaatgacgtcgaaaatattcagaaagccgcagagcggctggcggaactggtgccggaagcgcgaatcgctataggccacgggcagatgcgcgaacgtgagctggaacgggtcatgaacgatttccaccatcaacgttttaacgtgctggtgtgtactaccattatcgaaacggggatcgacattcccaccgctaacacgatcatcattgaacgcgcggatcatttcggcctcgcgcagttgcaccagctgcgtggccgcgtagggcgctcgcaccaccaggcctacgcctggctgttgacgccacatcctaaggccatgaccgccgatgcgcaaaaacggctggaggcgattgcgtcgctggaggatttaggcgccgggtttgcgctggcgacccacgatctggagatccgcggcgcgggcgagctgcttggcgaagagcaaagcggctcaatggaaaccattggcttctcactctacatggaattgctggaaaacgccgttgatgcgctgaaagcaggccgcgaaccctcgctggaagatctcaccagtcagcaaacggaagtcgagctgcgaatgccgtcgttactgccggatgattttattccggatgttaatacccggctgtcattctataaacgcattgccagcgcgaagaacgaaaacgagctggaagagatcaaagtggaattgatcgaccgcttcggcctgctgcccgatccggcgcgtaatctgctggatatcgcccgcctgcgccaacaggcgcaaaagctcggcatccgaaaactggagggtaacgagaaaggtggaacgattgagttcgccgagaaaaaccacgttgaccccgcctggcttatcgggttactgcaaaaacagccgcagcatttccgtctggatggcccgacgcgcctcaagtttattcaggatttaagcgaacgtaaaacgcgtatagactgggtacgccagttcatgcagcaactggaagaaaacgctattgcataagcgtcaggccgggcgtcattactctgcgcccggcctaatctttacaaattctttgcacttccctgcagttccagacacagccaaccgccataattcttatttcctcttttataaaaataaccacataataatcatgggcttattataatgttcaacaatacgcgactctctcgctggtgggcgttgcttgcgcttaccgcgaccatcatgcttgcccttcccgcgcaggcgaatacgtggcctcttccgccccccggcagtcgactggtgggagaaaataaattccatgtcgttgaagacgacggcggctcgctggaggcgatcgccaaaaaatataacgtgggctttttagccctgttacaggccaaccccggcattgatccttacgtgccacgcgcaggcagcgtgctgacgattccgctgcaaacgctgctaccggacgcgccacgtgaaggtatcgtcattaacctcgctgaattacggctttactattatcaaccggggaaaaatacggtcacggtctaccctatcggcattggccaactgggcggcgataccctgacgccaacgatggtgacgaccatttcggataaacgcgccaatccaacctggacgccgaccaccaatattcgcgcccgttataaagcgcaaggcatcgatctccccgccgtggtgcctgccggtcccgataacccaatggggcatcacgcgattcgtttagcggcctacggcggcgtctatctgttacatggcacgaatgccggttttggcattggtatgcgcgtcagttccggctgtatccgtctgcgcgacggtgatatagagacattgttccgtcaagtcacgccgggaaccaaagtgaatattatcaatacgccgattaaagcctcggtggagccaggcggcgtgcgactggtggaagttcatcagtcgctgtaagcgtgaatagctgactgacaaaaaagcctcgcgatgcatcgcgaggctttctctttttattgtggcaatcgcagcggcattaatgagggttaatgcttacttatagattaccgccgtaccgtggagggtattcgggccggtaacagaggtaatacggaaagacttcgcccccatttcctgcgctttttgcgccagctgatcttccagcgagcccagattcgtgccgccattcgcggaaatggtgccgaacttctgttgaccttctggcgttgcctgaacttcaacggcggcgaagctggcgaatgagagcgaactcagtaccgcagcagcgatgaggttttttacgtttttcatagtgatgacctttagcagatgaatgggtgtcgcaagcattaacttaacgatcgataaattaatcatagatgtgatctacatcacacgtcaacctctttttataatgatcgttatataatttataaagatgttatttttcatgtgaatagaattgatttatttttctaatgaatactctggagccagaagtggtttgtttttataatagagagaccgctctttaaacaggtacaacggcatcatgacaacggataccacgagttgcgcgaagaaaagccgtggccgaccaaaagtgttcgacagggaagccgcgcttgataaggccatgactctcttctggcagcacggctatgaagcaacttcgcttgccgatctcgtagaggctaccggggcgaaagcgcctactctctatgcggaattcactaacaaagaaggattatttcgcgctgtcctggatcgctacatcactcgctttgcctcaaaacacgaagcccagctcttttgtgaagagaaaagcgtagaatcggcgctggaagattacttcacagaaattgccgcctgctttaccagtacagacacgccggctggctgctttatgattaatacgtccgccaccctggccgcctcctcgcgcgatatcgcccgcacggtaaaatcacgccacgccatgcaggaacagacgctcatccagtttctgcgccaacatcaggagcgcggtgaaattccggcgcactgtaacccgcaggcgctcgcggaatatataaactgtattttacagggaatgtcgatcagcgcccgtgaaggtgccaccttcgaacaactgatgcaaattacgcgtacgactctgcgcatctggcctgaactgctcaagtcctgaacgacgcggcttcggataaaaaaagcccctcagcctgagcgaatgaggggctaacttgcagagtacagcttttttatgctttgttattcagaaccagttgaccattgccgtcgaggggaatttgcgttccggggtctttatccatgcggattttgccctgctgatcgccaattttgtaggtcacgtcgtagccaagcatcttttcagatttgtcatacaccgtcttacagcgttgctgcgtggtagtgtaggtatcactctcctgcattgatccctggatttgattgccagcataaccgccgcccagcgccccgacgaccgtcgccacatctttaccacgaccgccgccaaattgatgtccaatcacgccgcctgctactgcgccaagcaccgagccggcaatacggttttcgtcctgaaccggtctacgatgcgtgaccgtgacattacggcactcctgacgcggcgtttttaccgtctctttaatcggtttagccgatatcacctgcgcatactgcggaccacgatcaaatacgttgagactggccactgccgccacacccagcgcagccgctacgccaatccctatacccgccaacattgatttattcacgggagttcctccttcgttgctattggtaacaattttgcaaccagtatgcgaacaaagccaatcggaatgaggatgaaaaatgcgggatgaggcggtaaagctgaaggattcggacaactccgaagcaagtgatggagaagcgctcaccggcgagcagccggtgaggcgcagaaaaattaatgcagtttcaggcgcggacgaatgacgcggttaatactgcccaccagcatcatcaggccggttttaaagtatccatgcagcgctatctggtgcatacggtatagcgagatatacacgaagcgggcgatacgtccttcaatcatcattgaaccgcgggtcaggttccccatcagactacccacggtagagaagttggacagagagaccagcgatccatgatctttatactggtaagctttcagcggcttgccattcatctgcgccagaatgttattcatcgcgcaggtagccatctgatgcgccgcctgagcgcgaggcggcacaaaacctccctccggacgtgcgcaggaagcgcagtcgccaatcgcataaatatcaggatcacgcgtggtttgcagcgtcggttccaccaccagttggttaatgcggttcgtttccagaccaccaatttctttcataaaatctggcgctttgatacccgccgcccacaccatcagatcggcctgaatatattcaccttctttcgtatgcagaccgccttcgtcggcgctggtgaccatagtttgcgtcagtacgcgaacgcccagtttggtcagttcattatgcgcggcgctggagatacgcggcggcaacgcaggcagaatacgctcgccagcctcaaccaacgtcacgttcaacgcgtcgttggtcagccccttataaccatagctatgcagctgttttaccgcattatgcagttcagccgacagctcaacccccgtcgcaccgccgccaacgatggcgatattgaccttaccgttcgcgcccaggttagccgaatacttgaggaacaggttcagcatctcctggtgaaaacggcgcgcctgatgcgggttatcgaggaagatacagtgctctttcacgcccggcgtgttgaaatcattagaggtgctgcccagcgccatcaccagcgtgtcatacgcgattttgcgctccggcaccagcagttcgcccttttcatcacgcaactcggcaatggtgatggtcttcgcttcgcgatcgatatccatcaccgaccccagctggaactggaaaccatgattacgcgcatgagccagatagctcagcgcatccacgccttcgtccagagagccagtcgccacttcgtgcagcaatggtttccacagatggctgtgatttctgtctaccagcgtgattttcgcttttttcttgcgccccagtttatggcctaactgcgtcgccatttccagcccgccagcgccgccgccgacaatcacgatcttttttaatggtgtagtcaacgtgacccccttaaatttattaaccaattgttaattaaaagttattagtatagcctttaattaacaacaagttacgttaatgagaataagcttctgatatgagaatagcatgaacggtgcattggtcataccaaaattgatgtgcatcaagttttcatgctgaaaagatagacagtttgcgagaattgagcataaaaaaaccagccgcaaggctggttatccggtcactgataacgccatattgccggatggcgttaccccagcgttttaaacgctttgatacgttgcaagtgcggcgaaatatttttgaatttgtgagtctgttcctcatcccacacaatttcataaaacgggtgaagcgcttgcgctgagcgttggctgtccagcgcttcgtcatgacgcgagaggatcaccagacaacgatcgcgatttttttcgcgaaagttggtcacgcactttgtagcgatgtccgcatattcttccgggcgatcgattttcccctccatgttttcataggggaacaggttcgggttaaaaaccacctgacggatatcgcacaaaaagccaatccgctccgcccagtaaccgcccagccctacgccacagattaaagggcgctcgtccacattcaactgcaacattttgtccacttctttcagcagatgctgcatatcgtgcttaggatgccgcgtactgtagcttaccagccgaacatccgggtcgataaattgtaattgcaacactttttcatggttacccggactatttgaatcaaaaccgtgtaaataaataatcatctggcaccctcacgaaaactcgagttaatgacctgctttttcttcctgccagcgttcatgtaactggttgagctgggcgctggctgttttccagcgtgctgagtccatgagctcccggcgtgaaaatgaacctttatgatacaaacgtgtaacacgttctgctttgatcggcgacagattatccagcacgctgactgcgcctttacgattattgcagaccagaatcatatcgcaacccgcatccagcgacgcctgagcgcgctcagcatagctgcccataatcgccgcgccctccatagacagatcgtcggagaaaatgacgccgtcaaagcctagctcctgacgcagcaccgttttcagccagtacggcgaaccgcttgccggacgcggatcgatagcgcggtagatcacgtgggcaggcataatcgcatccagtttattctcactaatcagcgcgcggaacaccgacatatctttgccacggatgtccgtttcaggacgtggatcgcacggcgtctctttgtgggagtccgccgtgaccgcgccgtggccggggaaatgcttaccggtcgttttcatcccggcgtcatgcatgccgtcaataaagcgtgttgccattgccaacgcttttgcgggatcggcatgataagaacgctcgccaattgccgcgctgatatgcccaacgtccagcactggcgcaaaactgatatcaatatccatcgcgatcatttcgctggccatcagccaccctgcctcctgcgccagtcgccccccctcttccagcccatgcagcgcaaaaaaagattgcgccgcgggcaggcgggtaaacccttcacggaaacgctgtacgcgcccgccttcctgatcgacggccaccaccagatggttacgcgatgccgcccgaatctggcgcactaattcgcgcagctgttccgggtcatggtaattacgcgtgaacagaataagcccgccaaccagcggatgcgccagtatctcgcgctcctccgcatccagctcacatccttcgacattcaacattactgggcccacactgctctccttatcctttcatacgtagctggcgccaggtttcatcggccagcctgataaattgttgctcgccggtttgtcgccagcggtattcgaaccaccctgcttttagcataatgacccaggggtgccataatcgtatctgtcgccatagctgccgggcgtcgattcgcgcgcgcgcggcataagcgtctgccagttgtcggtgctggcgttcatcctcaacccatactgccgccagctccaacgcaatatcgccgtcgccggcatactcccagtcaatcagtctcaacccggcggacgttaatactatattgtcgccatggacatccatatgcaaaggcgcgagccgcagcgggcgaggttcaccgtttttttgcaactgtttgagccgccgcaaccaaaacggcgtacgccttgccggatcgcaacacgaccagtactgcgccaatagtggcgatagcgcgatacgccagccaaaacgcggctgttgatgcaaatgatacagtaaggccgccagttcgtcggcatctggcagagcggaatttaccacaccatgcagatattctaccgccatccagcctggcgtataaaaaagcgctcgcggcgccagactggccggcaattgggataaggcgcggtgatgacgtaaaaaatgggctggtggagcgtcggggtcgtgatgacggcgcagcacgatacggtgagtatcgtgagcaataatacagctcccgccgcttagcccctgcgatgcggcgacggcgggacgatactggggaaaatagcgcgacaggatctcgtcgcgcgttaagggattattgttgttggaccgcacctttacctgaccagattatctcgccagtttgcaccagcattaactgcatctgtaatgcaggcgcgttaacgttaccggatgcgctggagtaaagtacatattgcgccccgacattgcgcgcaatgccaatagctttactgcgcgttcccagactatcctgcggagacaaccctaactgctgttttgccatcgcgagttgctgtacggagaccagcgtaaatttaccgttgttcgccagcgcattacgtaacgtttccgttgcctcgttcgcatttaacgacccattcgtccggttattcacgctgtcgacaagcaatacgcttctggccgtcacgccatcagcctgcaacattttgctgaccagcggttgcatcgcgccgttccagtcatagtggcgcaccttaggcgctggctggcccgtttgatcttcatgttcgatcggccccggttgttgtggaatcgttggcacagacggcacaacaggaggctgcggcggctgcgcgggttgttctggcgctggttttacctcttcaactggcgcaggttgacgttgcgccatacacccggagagaaatatcgccagcgcagcaatggcggcgtagcgatgcatttttgtcatcaaaattcactcctcacaaataaagataaagcctgaccttatgcgcccccagataattggcgctgccaaatagcgttaccgacgaacgcgcgggtatggttacgctacgcggcgcctccagcggatgcatctccagcccccgcgcgtcataccagtaaaaccgataatgaacggttatgggctcttgcctttcgttatagacgcgggaagaagctgatggctggatatcagacgccgtcagttcaggcggctctgcggtgacacccgccgccagaaccgcggactccatcaccagcgactgcgcgtcgcttaccggaatttcaggatgtgaccggcagccggtaagcagcagcaagcccagagaaaccgcgatgcatcctttgatcatacttacaagcctttatgcgccagcatcgggcctagcgggcggccgcccagtaggtgcatatggatatgataaacctcctggcccccatgacggttggtattcatgattaaacgatacccatcttcggcaatgccttcttgttcagcgattttcgccgccacggtgatcatccgacctaacgcctgttcatgttccgccgtcacgtcattgacggttgggatcaggatattgggaataatcaagatatgcgtcggcgcctgcggtgaaatatcacgaaaggcggtgaccagctcatcctgataaacgatatccgaagggatttcacgacgaataattttgctgaatatagtttcttctgccacgacgttttcctttttcataatagcccttgcagcgcacatgctacgccgagccatactgcgagtatagagtatgagcgagttaccgacgctctttcaactttaacccacgatttattaagcgaaaaatgactacatgctggacttaccgccatatccccctgccatgacgcctttgtacgcttaaaaaatatttctagtttccctggttataccgttttacacatttaatacaaatgcgtatatttctcatttgcatttttatacgcattaactagcaaagaatgaaaaggttcaacgtcatacgtcctgaacttaccccaataacaagcaaggattttcagatgtctttcattcaataccgccgggacaaacaccttccgtccaccgccgcaccgtcgctgttagctatgggtatggcgatggcatttatgcctgccgccttcgcggctgaggataccgttattgtcgaaggcgcgacgaccgctgacgccataaaccgtgaagaacaggattacagcgtgaaaacgaccgcagcgggcaccaaaatgccgatgactcagcgcgatatcccgcagtcggtcagtattgtcagccaacagcgtatggaagaccagcagttgcaaaccctgggcgaggtgatgaccaatacgctggggatcagcggaagccaggctgactccgatcgcatcagctattactcgcgcgggtttgaaattgacaactatatggttgacggtattccaacgtattttgagtcccgctggaatctgggcgatgcgctaacggataccgcgctgtatgagcgcgtggaggtggttcgcggcgcgaatgggctgatgaccggaaccggcaatccttctgcctcaattaatatgatccgtaaacacgccaccagtcgggagttcaaaggtaacgtctccacagaatacggtagctggaataagcagcgttacgtcatggatctgcaaagtccgctcaccgcagacggtaatgtccgtgggcgcatcgtggcgggttatcagaataatgattcctggctggaccgctataacagtgagaaagcgttcttttccggaattatcgatgccgatctgggtgcaactaccaacctttcagccggttatgaatatcaaaaaattgatgtcaacagcccgacctggggcggtctgccgcgctggaataccgatggcagcaaaaatagctatgaccgcgcgcgtagtaccgccccggactgggcttataacaataaagagataaataaattcttcgtcacgcttaagcagcgttttgccgaaagctggcaggcgaccctgaatgcgacccatactgagggtcaaattcgacagtaaaatgatgtatatcgatgctttagtggataaagagacaggtacgctggtgagtccttatggcgcaagctaccccgtggtcggcggtactggctggaacagcggcaagcgcaaagtagatgccatagatctctttgctgatggcgcttatgagctgtttggccgtcagcacaatatgatgtttggcggcagttatagtaaacagaataaccgctattttagcgcctgggcgaacgtctttccggacgacattggcaacttcggcgcctttaacggtaatttcccccaaacccactgggcgccacaaaatctggcgcaggacgataccacgcatatgaaatcgctgtatgccgctacgtgcatttcgctggccgacccgctgcatctgattcttggcgctcgttataccaactggcgtgttgatacactgacctacagcatggagaaaaaccataccacgccgtatgccgggctgatttatgatatcaacgacaactggtccgcttatgccagttatacctctatctttcagccgcagaataaacgcgacaaagcgggtcaatatctggctccgattaccggtaataactatgaagcgggcctgaagtccgactggatgaacagccgcctcaccactacgttgtccgtgttccgcattgagcaggataatgtcgctcaagcaaccactattcccatccctggcagtaatggggaatttgcctggaagtctactgacggaacggtgagcaaaggcgtcgaatttgaagtgaacggcgcaattaccgataactggcagatgactttcggggctacccggtatgttgccgaggacaatgaaggtaacgccgtgaaccctaatctcccgcgcaccagcgtgaagttattcacccgctatcgtctgccggcgataccggagctgacggtcggcggcggcgtgaactggcagaatcgggtttacaaagataccacgacgccatacggcaccttccgcgccgaacagggcagctatgcgctggtcgatctgtttacccgctatcaggtgacgaaaaatttctccgtacagggaaacatcaacaacctgttcgataaaacctacgacaccaatattgatagttccattgtttacggcgcgccgcgtaacgtcagcctcaccgccaactatcagttctgacagactgtcggagagcgtcatgtaaagcgccattaaaaaaggcagccgaatggctgccttaatactccccaacatcattactgcttagctgttacggatgtactcatccatttccgttttcaggttatcggatttcgtaccgaaaatagcctgaacgccggaacccgcgacgacaacgcctgccgcgcccagtttcttcaggccagcctgatccactttcgctacatcggctacgctcacgcgcagacgcgtgatacaggcatccaggttagtgatgttctctttaccgccaaacgccgcaatcaaagccggcgccatttcgctggtagcgcccgcttttgcgtcatcagtagagtcttcacggcccggcgttttcagatccagcgctttgatcagcacgcggaacacggtgtagtacacaatcgcataaccggcgccaacaatcgggaacagccacaatttgctgctgttaccggacagcacgataaagtcgatcagaccgtgggagaacgacgtaccgtcacgcatccccagcaggatacagatcgggaatgccagacctgccagaatcgcgtgaataatgtacaggatcggcgccacgaacatgaaggagaactcgataggctcggtaatacccgtcaaaaacgaggtcagcgcggcggaaatcatgataccgcccacttttgcgcggttttccggtttagcagagtgccagatagcaatggccgcagccggcagaccgtacattttgaacaggaagccgccagacaacatacccgccgtcgggtcgcccgccatatagcgcggaatgtcgccgtggaatacctgacccgctgcgttggtgtattcgccgatctgcatctggaaaggaacgttccagatatgatgcagaccaaacggcaccaggcaacgctcgataaaaccgtaaatgccaaacgcgacaaccgggttctgataagccgcccactgcgagaacgcctggatagccgtaccgactggcggccatacgaaagacagcaccacaccggtaaaaatagcggccagacccgaaatgatcggcacgaagcgtttgcccgcaaagaagcccagatactcaggcagtttgatacggtagaagcggttaaacatatacgctgcgatcgcaccggagataatccccccgagaacacccgtatcagcaaggtgtttagcggcgatctcttcagcaggtaaatgcagaaccagcggcgcaaccacagccatggttttcaccatgatgccatacgctactaccgccgccagagccgaaacgccgtcgttgttggtgaagcccaacgccacgccgatagcgaaaatcagcggcatattggcaaaaacagatccgcccgcttctgccataacgtgcgatacaacggctggcagccagctgaagttagcggaaccgacacccagcaggatacctgcgatagggagtacggataccggcagcatcagcgatttaccggccttttgcaggttagtaaatgcattcttaaacataattgagagtgctcctgagtatttgtgcttttctacgttctcacgcattggcgaggggggagaaccccgccgtggacaggacatctaagtgcccttttatttattacacagagtaaaataaatacgtctgattttgtttgacggctatcacgtttcagcgccagatagcctaaaaagtatcacattctgccaaaatgagttttcgaatgtttccataagctcgctcaccgccccttttgtggcggtgaactttacgcgctttgcttattaattacgagctttaaaaaaactcgtttaacggattgatgacaggcgagacgcgtcaatatggaacaggcgagcaaagttatcggtggtgatctgcgccagttcttcaacggcaacccctttcaataccgccatatattctgcgacgtcgcgtaccatcgcaggctggttctctttaccgcgatgcggcaccggcgccagataaggagaatcggtctcgactaataaccgatccagcggcacatagcgcgccgcatcacgcaactgttcagcgttacggaacgttacgatgccggaaaaagagatataaaaccccagatccagcaatttgccggccgtttctctgtcttctgtaaaacagtgtagtacgccgccgcaatccgtcactttttcttcgcgcaggatagccagcgtatcggcacgcgcgtcgcgagtatggacaatcaccggtttatgcaattcgcggccaatctggatatgatgaataaaagacgcctgctggcggattttggtctcaggcgtgtaaaagtaatcaagcccggtctcgcccatcgccaccacatcgtcttctgcagcaaggaggcgcagttcttctacgtcatatacttcatcctgatttaacggatgcacgccgcaggaaaagaccacattatcgcgcttgcccaccagctcgcgcatatggcgataccccggcaacgtcgtcgccaccgctaaacagaacttcacatcgcgcgcggcggctttcgccagcacatcgtccacgtccttatgcaaagattgataatccagaccatcaagatggcagtgtgagtcgactaaaaacataatgtctctctcaaagatgaggaacaggcaacaaggtgcctggttgcaggtaatgctcgatgcggagaatgagatcggttaataccagttcgcgatttaatccggtcacatgaagtaattgatcacgacaatggcaaacatcgttcaggattgcctgaatacgcgccggggatagcggccccgccagcgcggcaacaaccgcgtccgcatcaacgtttgtcaggtacgacgcgccgtgctgacgtttcagcgcgtctaccagcagcgtcgccagccagtgcaggcgcgccggggcttgctcatgattgagcgccgttaataacgcataccagtcgcccgtatgtaaactgtccatcaacgcctgacacagcgcctcacgctgcgcccaacgttcagactgcaacagcgccagcgcggcgccgggcgaccccgcgttcaggcgtagcgccgtgagcaatgcttcttgtgacgccgtcacttctcgcgacagccatgacatcgcatacgattcggacggcggcgccagatgatgcagccgacaacggctgcgtaatgtcgccaacagacgagcaggctccgggctggcaaggaaaaaccaggtttgctccggcggctcttccagcgttttgagcaacgcattggcggcggcgtcggttaatagcgccgcatccgcaatccacaccaccttcgcaccacccagacgggagtgctcgtacaatttctcgctgacctcgcgtaccgcatctacaccaaggctgcttttgcctttatccggcgtcagcgtgtaatagtccggatgcgtgccagcctgcataagctgacagccacggcaatgcccacagcttttgtggccctcaggctgctggcataacagataacggctcagcgcatagcacagcgcctcgtcgcccatgccaggtaaggcctgaatcagtagcgcatggtgcccacgtcccgcctggtaactttctaccagtttttcataggcgggccgtaaccatggataccatttcatgccgcttgctcctgcacccacttcgtcaccgtggcgcgaatgtcgcgcatgacggcatccagcggctgggtcgcgtcaatggtgcggatacgcgagtcttgcgccgccagttccagatagcgcgcgcgagtccggttaaagaaatcaaaagattcctgctcaatgcgatccaaatcgccgcgcgctctggcgcgttttagcccgacttccggcgtgacatccagatacagcgtcaggtcaggacgaaaatcgcccagcacggcatcgcgtagtgtcgccagcatggtttgatcaatgccgcgccctcccccctgatacgcctgggtcgagagatcgtggcgatcgccgatcacccatacgccttgcgccagcgcgggtttgattaccgtttcgacgagctgtacgcgagcggcataaaacatcagcacttccgctttatcggtaatcacttcgtcgcctaccgatcggatatccagcaccagacttcttagtttttcggcaagctgcgtaccgcccggctcacgggtaaaaatcatgttacgaatacccagttgctcaagggtctccaccaccacgtcgcgcgcagtggtttttccggcgccttccaggccctcgatgacgatataattactgcccatttttttccttaagcactttctcctgcactgaccgattatggctggcaagattggtgttaaatgtgtgaccgcctttaccgtcggccacaaaatagagatacggcgttttcgccggatgcgccgccgcctgcaatgacgcttcgctgggcgatgcaatcggtcctggcggcagcccggttatggtatacgtgttataagccgtcggcttttccagatccgcacgcgacaagttaccattataactcgtccccatcccgtaaatcacggtgggatcggtctgaaggcgcataccgattctcaggcgattaataaagactgaggccacctgatcgcgttcgctggcgacagccgtctctttttcaataatcgaggccattgtcaccagttggttctgatctttataaggcagcccctcggcccgacctttccagacagtatcgacagctttcaccatcttttggtgcgctcgcttgagaatagcgacatcgctggtgttggcggtatacatccaggtatcaggccagaaccacccttctacccattccgggtgcgcaagctttaatgcctgagcgacagtggcgtagtcatcatccggcaatgtatggcgaatatacggcgcctctcgtaactgtttcaggtaatcgctaaggcgcatcccttccacaaaccgcaacgggaattgcgcttctttgccgctctccagcaactcaagcatctcccgtacggtcatcccgggcgtaaaacggtaagttcccgctttaaagtgcgataactcaggctccacgcgcagcagccactgaaatacccggggacgattaatgattttttcatcataaagctggtcaccaagcgccagccgacccgttcccgccttgagcgtaaagatagtctcgtttttaataagtaacgtgctgttcgccagatggcgaactttccacatccccacgcccgtggcaatacccagcacaaccaacagcagaaggaaaacgcctgacaattttttcataactaattcggatgctcacaaaatggggctaaaaattgaaacagtgttcgcgaagaatacgacgtcccgtgataggcgcgtatgggaataatcggcattagcgcgttgcagatgataatctcatccgcctgcctgactgcctcctctctcgcctgtacttcaagaacctggaaaggagattgcgccagttggcgtaaacaaaattgtcgcataatgccgttcaccccggcctgatccagacgcggcgtaaaaacaatgtcgcctgtacgccagaacaaattagccgcacagcattccgtaacccatccctcgctgtcaagaaccagcgcctcatcggcgtccgtctgctcaagatgagagcgaatcaacacctgttcgaggcggttcagatgttttaatccggcaagataaggattgcgcccaagcggtatgggactaagggtaagagtgatgccttgcttacgccactgagaataataagcgggataagcagaaacggagaggattcgggtagctgcctgacaattcatggcgctgtatccccggccgccgctaccacggctaatgatcactttcaacacgcctgaatcatgccctgtggccaacattgtcatctcttgccgaagggtcgaccaatggctaaaagcgatccgtaatttttcacaggcaacctgcaagcgctgaagatgcgcttccagatggcaaatgttgccatcaacaatacgtgcggtcgtaaaactgccatcgccgaactgcgtcgcccggtcgcttacagcaagttgatcctgcgcatggccattaattaaaaacatagtggctccttatccgtcgcctgctagtgtggcaggatgaataacgcagaacaagaggtgatatgcctgataaaaaaggcccgacaagcggacctttttattaatgtctgtctctggcttaacttagatctttttaaagatcaaggaaccgttagttccgccaaagccaaaggagttacacagcgcgtactccagatcgctgacctggcgcgcttcatgcggcacgaagtccagatcgcaaccttcatccgggttatccagattaatggttggcggaatggcctgatcgcgtagcgccagaatagagaaaatagactctactgcgcctgcggcgcccaacagatggccggtcatcgatttggtcgagctcaccatcactcggcttgcagcatcgccaaagactgacttaaccgcctgcgtctcagctttgtcgccggcaggcgtcgacgtgccgtgcgcgttgacgtagccaatctgagcaggctcaatcgcggcatcacgcaacgcgttaaccatcgccagcgcagcgcctgcgccattttccggcggcgacgtcatatggtaagcatcgctgctcataccaaagccgacgatttcagcatagattttcgcactacgcgcttttgcatgttcgtactcttcaagcaccaacataccggcaccgtcgcccagtacaaaaccatcgcgttctttatcccacggacggctcgccgcctgtgggttatcgttgcgggtcgacagcgcgcgcgctgcgccaaaaccacctacgcccagcggcgtactggctttttctgcgccacctgccaccatcgcgtccgcatcaccataggcgatgatacgcgcggcatggccgatgttatgcacgcctgaagtacaggcagtcgcaatagagatgcttggcccacgcaggccatacatgatagtcagatggcctgctaccatgttaacaatcgtcgacgggacaaagaacgggctaatcttacgcggtccgccttttaccagcgaactgtggttttcttcgatcagaccgagaccaccgataccggagccgatagcggcgccaatacggcttgcgttctcttccgtcacttcaaggccagaatcctgcatggcctgtacgccagcgacaattccatattgaatgaaggcatccatcttgcgctgttctttgcgcgagataatgtcatcacagttaaaatcctttactaagccagcaaatttcgttgcataggcgctagtatcgaaatggtcgatcaggctgatgccactctgaccggcaaggagagctttccaggtagactctacggtattgccgacaggagacaacatgccaagtccggtcacaactacacgacgcttagacacggttgtcctccagggagggaaaatgattctagtgggacaaaaagataaaactcaggcggtcgaacgaccgcctggagatgttcacttacgcctggtggccgttgatgtaatcaatggcagcctgaacggtggtgattttctcagcttcttcgtccggaatctcagtatcaaactcttcttccagagccattaccagctcaacggtgtcaagagaatctgcgcccaggtcttcaacgaaagaagcattgttggttacttcttcctgcttaacgcccagctgttcgccgataattttcttaacgcgttcttcgatagtgctcatactcttaaatttcctatcaaaactcgctttcgcgatggttttcgtagtgtataaaatgttgaaaaatttgcaactaaatcccggcaggtcttaccacgattttacgttattttgcggcctttcgccctaataacgcaaatatttttcaatcgtgattaaaccatgtacattccgccgttgacgtgcagagtctcaccagtgatgtaactcgcttcgtcagaggctaaaaatgcaaccgcactggcgatttcctgagcgccgccgaggcgacccgcaggcacctgcgccaggatacccgcacgctgatcgtcagacagcgcacgcgtcatgtccgtttcaataaaacccggagccacaacattgacagtaataccacgggacgcaacttcacgcgccagtgatttactgaaaccgatcaggcccgctttcgccgcagcgtagtttgcctgacctgcatttcccatggtaccaaccacagaaccaatagtgataatgcgaccacaacgctttttcatcatagcgcgcattaccgcttttgacaggcggaaaacggatgataaattggtttcgataatatcgttccactcatcatctttcattcgcatcaacagattatcacgagtgataccggcattattaaccaggatatccacttcaccaaattctgcgcgaatattttccagaacagattcaatagatgcaggatcggtcacattcaacatcaaacctttcccgttagcacctaaatagtcgctaatgttcttcgcaccattttcactggtcgcagtcccgataactttcgcgccgcgggcaacgagagtctctgcaattgcgcggcctatgccacggcttgcaccagtcaccagcgcaatctttccttcaaagctcatggttttcctcttttattgcgtaagtgccgcagacagcgccgccggctcgttcagcgccgacgctgtcagggtgtcgacaatacgtttcgtcagaccagtgaggactttacctggacccacttcataaagatgttcaacgccctgcgccgcgataaattccacgctcttcgtccactgtaccggattgtacaactggcgaaccagcgcatcgcggatagcggcggcatcggtttcacatttcacgtcaacgttgtttactaccggcaccgttggcgcgctaaaggtaattttggctaattcaaccgccagcttatctgccgttggtttcatcagcgcgcagtgcgacggcacgctcaccggcagcggcagcgcgcgtttcgcgccagcggctttacaggctgcgcccgcgcgttctaccgcctctttatgcccggcgataaccacctgtcccggcgagttaaagttaaccggcgaaacaacctgcccttcggcagattcttcacaggctttagcaatagaggcatcatccagaccgatgatcgcagacatgccgccagtaccttccggaaccgcttcctgcatgaatttaccgcgcatttccaccagacgaacggcatcagcaaagttgatgacgccagcgcaaaccagcgcggaatattcgcccaggctgtgacctgccattaacgcaggcattttaccgccctgctgctgccaaacgcgccaaagcgcgacggaagcggttaatagcgccggctgcgtctgccaagttttattcagttcttccgctggaccttgctgggtgagcgcccacagatcatatcccagagccgcagaagcttcagcaaacgtttcttctacgatagggtaatttgccgccatctcggccaacatcccaacgctctgagaaccctgaccggggaacacaaatgcaaattgcgtcatgtttaaatccttatactagaaacgaatcagcgcggagccccaggtgaatccacccccgaaggcttcaagcaataccagctgaccggctttaattcgcccgtcacgcacggcttcatccagcgcgcacggcacagaagccgcggaggtattgccgtgcctgtccagcgtgacgacgacattgtccatcgacatgccgagttttttcgctgtcgcgctaatgatacgcaggttagcctgatgcggcaccagccaatcgagttctgagcgatccaggttattagccgccagcgtctcatcgacaatatgcgccagttcagtgaccgccactttaaagacttcattacccgccatcgtcaggtaaatcgggttatccggatttacacgatcggcattcggcagggtcagtaattcaccgtaacggccatcggcatgaagatgagtggagataatacccggttcttcagaagcgctcagtacggccgcgcctgcgccatcgccgaaaataatgatcgtaccgcgatcgccaggatcgcaagtgcgggctaatacatcggaaccgaccaccagcgcgtgtttaaccacgccggatttaacgtactggtcggcgatacttaacgcgtaggtgaaacctgcgcacgctgccgcgacatcaaacgccgggcaacctttaataccgagcatactttgaatctgacatgccgcgcttggaaatgcatgcgttgctgatgtggtcgctaccacaatcaagccaatttggtctttatcgatccccgccatctcaatcgcgcgattcgcagcggtaaagcccatcgtcgcgacagtttcattcggcgcggcgatatggcgttcacgaatacctgtacgagtgacaatccactcgtcagaggtctcaaccattttttccaaatcggcgttagtccgcacttgttcgggcagatagctgccagtaccaataatcttcgtatacatgtacgctcagtcacttttcggttatataccgttacctgtaaacgtctggcacgctggcggcgccggggagacagcgatattatctgtgcgcccgcaggtttacgcctttgccatcgtccagcggttcaaatccggctgggtatacagattccaggcgagcggcaattcgctgaggaacttgtcgctgcaccgcctgcactgcctgttcaatcgcgactgcaaatgctcgctgattggccgcaccatgactttttatcaccgtgccgcgcaatcctaacagacaggcgccattatactggtcggggttgaggtgactgaatcgcctcgtcaggcttttttgtaaccaacgttttaataacagcagccaccacgaccgttttttcccctcgccctgtgatttcagcagtgaaaggaacattctgacaaccccctccatcgttttaagcgtgacattgcctgtaaagccgtcacacaccagtacatcggtttttcccgtcagtaactcattcgcctcaaggtagccgatgtaattgatggttgggactgtttttaacattaaagaggcttcgcgaatactgtcgaggcctttggtttcttcttccccgatattgagtagcgccacgcggggatttttgatcccgacgacctcttccgccaaaacggcgcccatcacggcaaactgcaccagcatggtactgtcgcaatcgacgttggcccccaaatcaagcactaccgttttgcccttttgctggtgcggtaataccgtcaccaacgccggacgctcaatcccctcaagaggcttgagcaataatttcgccagccccatcagcgccccggtattaccggcgctaacgcaagcttcggctcggccttctttcacaagctccaaggccacacgcatggatgtcccgcgactggcgcggatcgcctgcgaaggccgggcatcactggcaataactgactgtgcagggataatctgcagacgcgaacgttgttcaaagtcagctttggcaagtaatggcgtgataatatcgggattcccgactaaaagaagagtgagctgcgaattagcgttcagtgcctgcaatgctgcaggcaccgtcacggaaggaccaaaatcgccccccatgacatctaacgccagggttagacgtgtcaaggtatcgtcgctgcctggttcggtgttctccgcttacgcggagaaatcctcactaagctttatcacgcttgtactcttcggcttttacaccacaggcacgcctgtgatgcaaaaggcatcgagtatcgcgcgattacttagcgatgaccttacggccgcggtagtaaccgtcggcagtgatgtggtgacgcaggtgtttttcaccagaagttttgtctacagacaggctggtgactgcggtcagagcgtcatgggaacgacgcatgccacgtttggaacgggttggtttattctgttgtacggccatggaccttactcctcaattacggtttatccctgcgtccgcggggaagacctattacttacgctttaagctggctaatacggcaaatgggtttggcttttgcgcttcatcaggcagttcgccaaagaccatgtccgcctcggacacttcacagtgttcagaatcatgcaccggaactaccggcaaggcgaggatgatttcatcttcaaccgtcgccagcagatcgatttcgccgaattcgtttacctcaatcggctcatacgcttccggcagtgcttcagcctgctcgtcggaacggacagggctaaaacaatacgttgtgtgaacctgatgggtaaacggtttcccgcaacgctggcattcgagcgacaccgtaacgaccgcatcgccagtcaaaacggcgagacgctggttatcgatagcgaacgacatggagcattccacatcactgtccacactgactacagattcggcaacgcgctcaacctgatcgggggtatagataccctggtaatcaaggcgtttttgagcggtacgaaccggatcaagagtcaggggtaattttaccttttgcatagggcgcgcatattaacttcgtaacgtcatatagtcaaagaaaaaggcagcctgcggttgccttttgccaataattcgcacacattgcgggttacagacttattttcgctcaagacgagtcagtatgacaggcttgaagaccgaagagcatagtttaagatggctctcatcattacgctatatctgagggaaaaaatatgccccgtctcatccttgcgtctacctctccctggcgtcgcgcgctgctggaaaagctgacgattcctttcgaatgcgccgcgccggatgttgatgaaacccccatgccgggcgaagcgccgcgtcagttggtgctgcggctggcgcaggctaaggcgcaatcgctcgccgcgcgtttcccgaatcatttgattattggctccgaccaaatttgtgttctggacggcgaaatcaccggcaaaccgctgacggaagaaaaagcgcgtcagcaattagccaaagccagcggaagtattgtgacgttttataccggactggcactgtataactccgcctccgggcacttacaaaccgaagtggagccttttgacgttcactttcgccatttaagcgaagcggaaatagacgactatgtccgtaaagagcatccgctgcactgcgcgggaagttttaaaagcgaaggtttaggcattgcattatttgagcgcttagagggccgcgatccgaacacgctgatcggcttgccgcttattgccctgtgccagatgctgcgacgggaagagatgaacccgctgaatgcctgattaatctgcctgatggcgacgcgatgcgtcttatcaggcctacggtgcatcacacgattgtaggcctgataagcaacgcgcatcaggctttactacgtaatacctcaaggcagcgcttcaattgcttatccattggcgcttcaatgcgcatgacatcgcccgttcccggatgcgtgaacttcagcgccgcggcgtgcagaaagagacgtttaagaccggttcccgcttcggtaagctgttgatcaaactcacggtcgccgtagcgatcgtcgaacgcaatagggtgaccggcatattgggtatgtacgcgaatctgatgcgtacggcccgtgaccgggctacagcgcaccagcgtggcgaaggcataacgctcttccaccttgaagcgcgtttctgaaggtttgccttcctggctcacgcggacaatgcgttcgccgctttgcagaatgttctttaataatggcgcctgtacggttttaacgtgtgattgccactggccgcgcaccagcgccagataatctttctgcattcccttttcgcgcagttgctcatgcagcgaacgcagcgcggagcgttttttcgccaccaacagcacgccggaagtatcgcggtcaagacgatgcaccagttccaggaatcgcgcttccggacgcaacgcccgcagcccttcgatgacgccgaaacttaacccgctcccaccgtgtacggcggtgccggaaggcttattcagcaccagaatatggtcgtcttcatacaaaatgacgtccgccaacgccgccactttttgcaaatgcggcgacacagcctcttcttcgcgctcagcaacgcgaaccggcggaatgcggacttcatcgcccgattccagtttgtattccggtttaatgcgttttttgttcacccgcacctcgcctttacgcaagatgcgataaatcatactttttggtacccctttcagttgggtgcgcaaaaagttatcaatgcgttgccccgcttcgtcagcggcgatagcaacaatttttacggatggcgtttctgttttcatggggggcgattctaaatagcctgtgagattcgcgccacacatttttctatgcttatagagacgtctacgccagtggatgaacatttttcactgcggttttgctggttattaaagcgattggctcgcgctggtgaaaaaactgtgagtaagcgggtgataaatggtaaaagtcatcttgctataacaaggttagcagtggaataatgatgcggtttccgcaccgaaacttgttaaaacaaaaagtttagcggaataacccattttgtctgaccgatcatcaacgcagcaatggcgtaagacgtattgatttttcagacagttagcgggctgcgggttgcagtccttaccggtagataggatcttctctggagagtaatgcccaggctgcttccctgataattgcgctgtgtttccgtatgaaatacaggcaaccgacactctgcgcctctttgagctgacgataaccgtgaggttggcgacgcgaaatagtcacgaggccatcggttcatgcccggtaaggcgtcaccatgcccgcagcttagtcgtcaacgtaagaataatgagtaagttacgatgaaaagaatgttaatcaacgcgactcagcaggaagagttgcgcgtcgcccttgtagatgggcagcgtctgtacgatctggatatagaaagccccggacacgagcagaaaaaagcgaacatctataaaggcaaaattacccgtattgaaccgagcctggaagcggcttttgttgattacggcgcagaacgccacggtttcctcccgttaaaagaaattgcccgcgaatatttccccgctaactacagcgctcatggtcgcccgaacatcaaagacgtgttacgcgaaggccaggaagtcattgttcaaatcgataaagaagagcgcggcaacaaaggcgcggcgttaaccacctttatcagtctggcgggcagctacctggtactgatgccgaataacccgcgcgcgggtggtatctcccgtcgcattgaaggcgacgatcgtaccgagttaaaagaagcgttggccagcctggaacttcctgaagggatggggcttatcgtacgtaccgcgggcgtgggtaaatccgccgaagcgttgcagtgggatttaagcttccgcctgaaacactgggaagccattcagaaagccgctgaaagccgtcccgcgccgttcctgatccatcaggaaagcaacgtcatcgtacgcgcgtttcgcgactatctgcgtcaggatatcggtgaaatcctaatcgacaatccaaaagtgatggaaatggcgcgtcagcatatcgccgcgttgggccgcccggattttagcagcaaaattaagctatacaccggtgaaatcccgttgttcagccattaccagatcgaatcgcagatcgagtctgcgttccagcgtgaagtgcgcctgccctccggcggctccatcgtcattgacagcaccgaagcgttaaccgctatcgatatcaactccgcccgcgcaactcgcggcggcgatatcgaagaaaccgcgttcaacaccaatctcgaagcggccgatgagattgcccgccagttgcgtctgcgcgacctgggcggcctgatcgttatcgactttatcgatatgacgccggtacgtcaccagcgcgcggtagaaaaccgcctgcgtgaagcggtgcgtcaggaccgggcgcgtattcagattagccatatttcccgcttcggcctgctcgaaatgtcgcgtcagcgcctgagcccgtcgctgggcgaatccagccatcacgtgtgtccgcgctgtagcggtaccggcaccgtgcgcgataacgaatctctgtcgctgtccattctgcgcctgattgaagaagaagcgctgaaagagaatacgcaggaagtccatgccattgttccggtgccgatcgcctcttatctgcttaacgaaaaacggacggcagttaacgctattgagacgcgtcaggatggcgtccgctgtgtcatcgtcccgaacgatcagatggaaacgccgcactattccgtgctacgcgtacgcaaaggggaagaaacgccgaccctgagctacatgctgccgaagctgcacgaagaagcgatggcgctgccttctgaagaagagtacgccgagcgtaaacgcccggaacagcctgcgctggcgacattcgctatgccagatgtgcctccggcgccgacgcctgtcgaaccggcggttagcgttgccacggcgaaaaaggataatgttgccgccgagcagcctgcccagccgggtctgtttagccgcttccttaacgcgctgaaacaactgttcagcggtgaagaaacgaaaaccgtcgaaacagccgcgccgaaagcggaagaaaaagcggagcgtcagcaggatcgtcgcaagccacgacagaacaaccgtcgcgatcgtaacgaacgccgcgacacccgtgataaccgtgccagacgtgacggcggcgagagccgcgacgataatcgtcgtaaccgtcgccaggcgcagcagcaaaatgcggaagcgcgcgatacccgccagcaggaaacggcggaaaaagtgaaaaccggcgatgagcagcaacagacgccgcgtcgcgaacgcagccgccgccgcaatgatgacaaacgccaggcgcagcaggaagtaaaagcgcttaaccgcgaagaacagcctgtccaggagaccgagcaggaagaacgcgttcagcaggttcagccgcgccgtaagcaacgtcagcttaatcagaaagtccgctttaccaacagcacagtggttgaaacggttgacacgccggtcgtcgtcgacgaaccacgcccggttgaaaacgttgaacagcccgttccagcgccgcgtaccgagctggcgaaagttgatttacctgtcgttgccgatatcgcgccggagcaggatgatagcgtagaacctcgcgataataccggtatgccgcgtcgctcccgccgttctccgcgccacctgcgcgtaagcggtcagcgtcgccgtcgctatcgtgacgagcgctacccgacacaatcgccgatgccgttaaccgtcgcctgcgcgtcgccagaaatggcgtccggtaaagtctggatccgctacccgattgtccgtcctcaggaaacgcaggttgttgaagagcagcgtgaagcagatctggcgctgccacaaccggttgtcgctgaaccgcaggttatcgctgcgaccgtagcgctcgaaccacaagcgtcggtacaggcggtagaaaacgttgccgttgagccgcagaccgtcgccgaaccacaggcgccggaagtcgtcaaggtcgagacaacgcatccggaagtgattgccgcgccggttgatgaacagccgcaactgattgccgaaagcgatacgccggaagcgcaagaggttattgctgacgccgaaccggtagcagaaaccgccgacgcgtccattacggtggctgaaaacgtagctgatgttgtcgttgtcgagccagaagaagagacaaaagcggaagcggctgttgtggagcacacggcagaagaaaccgttatcgcaccggcccaggtggtggaaaagccgcaggacgttgtctgcgttgacgatcataaccacgccagcgcgccgatgacgcgtgcgccagcgccggaatatgtgccggaaaccccgcaccatagcgactggcagcgcccttccttccactttgaaggtaaaggcgcagcaggcggacacagcgccacacgtcacgccagcgccccggcgacacgcccacagccggtagaatgatgtaaatgctgatacaaagccgaccgccaggtcggcttttttttatgcctcttacagggcgatgcctcaccccatggcgtcttttagtcactccaggcgtttatgagatcgggcgggataatacgtacggatggcgtcgctacgggcgcgacaatatgaccactaactcaataacgactaaataaatatcctccggcatagccggaggtttttctgatgcgcctgtaaggctctcttaccagccgcgccctaacaggcgcatacgatctgacatttgcatcaaacttcgttacttacggcccgtaaacgggctgcccggataagggatcgataattgctcacccattttatcctcttcaagctggtgctttatgtagtcctgtatcttcgccgtgttcttacccactgtatcgacatagtaccctctgcaccagaactccctgttcctgtatttgaattttagatccccaaactgctcgtaaagcatcagactacttttacccttcagatatcccatgaagctcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaatgcccgcgccggggtggatggcgcgggcagacaaaacatatccagtttcgtgatatgtttcaaaaagaggcgttaccggttcaactggaaaagcgacattccctgcatgtcggtaaacgttttataggacgcctgtaatgccgcctgttgcatgacgtaggaggaaatgaccgagttccagtccacatctaccaggttgctcatctgtagcttctgtcccagcgcacggtcgcttcccagtgaatccagcgtactgagttcgctcagttgcgttcccagttccgcacgaacggtcaggacgttattaagcgaattttttaagccgcgattggttttatcaatggcggcagcggctttttctttttccacgtcattgccttccaccggggtcttgagcgcggcaattgccgtatcgagcatgacaaacagattcttttcggagtccgagccatccggttccggcaccgcattgctggtgatgctattaaaaatttgcgctcccgtatggccaattaccatcgtgcgtgcggaatccacctgctgggtaacacttttctcgccgccatgataaccacctgtcgcctggtcgaatggcgccgcttccgttttatacccggcaaagatatagcgaccattgccgtcagtgctgtttgccaggttcatcagctgatcgcggatcccctgtaaatccgtcgccagcgacgcgcggtcatcgtcgcttaacgtgccgtttccggcatagacgattttttcctgcgcggtttgaatcgccgtcgtcacctgactgagtacgctttcttccagcgacactttttgggtggcaaacgtacgcgccagggcgtactggctattctgcgcctgcgcctgaaagagtactaccgcctgcgacgcggcgatcggatcgtcagatgggttggtaacgcgcttaccggtagacatctgctcgcccagcttcatccattcggcctgagaattagtgatgccgctcatattttgttcgtacatcatctgggtactgatacgcatgtcatccttctcctttagcgaatattcaataacgcatcaaacagcgcattcgcggtctgcaatacttgcgcattcgccagataatactgctgataacgctgcaaattgccgtactcttcgtcgaggttaacgccggaaaccgactgttgctgtttataaagctgtttaaccacattcgcctgcgtggtgctgctggttttcagcgttgacgttttgttacccacatcgctgaccaacgtggcgtaagcatcgttaaaggttttgttgccgcccactacattgctgttttgtaagtccagcaatgcctgaccattgcggttatcgctgtcgccggtatccacatcaggatcgagttttgactcagacgccatcgcaatctcggcttcatttgtcactttaacgttcatgtcgacgatagcattgctgaccggcttgagaagaaaactgtcgtttttctgtgcgccagtccctaccgtcactttcagaccgtcaatctccagttttccgtcagcatcttttgttgccgtgaaggtggtgttatccgcagtgcgagtaacctgccagtctgtaccgtcaaaaacaatcttataatccgtcgcctgaaccttcgtgctgtcgaccaccttagcggttagcgataccgttttatcggcattattactgttgctatataccaccggcgagccaatgctaaagaagtctttccctttattgccgtcggcgtcataacctttggtatgctgcgcgttaaacgcatcggcaaacgccaacgccaactggcccagcgtattacgagtctgatccagatcctgagaacggaacgtcagtagcccgccgagcgaaccggtgttcagcaacttttccggaatttcgatgttaccggcggcctcatcgacataagcgacagtcgttcgcgtcgggtcggcgctggagggaaccgccgccaactgacgcgccgtcgacccctgcaccagcgtatagccattggccatcgtcaggttataggtgccgccgtcctgtacactcacctcgacgccaacgatcttgttaagctcgctaaccaactgatcacgttgatcgagcaggtcgttcggcgatgcgcccgcgcctacgcccgtcatacgggagatttgatcgttcaggttagctatctgcttcgcgtaattgttgatttgcgccacgctggagccaatcgcgatattgacctgtttatcctgatcgcgcagatactgatcggtggttttgaactggtttaccagcccttccgctttaccaatcagcgcctgacgcgccgcaggatcttccgcattactgactaacgtttgcaggctggtaaaaaaactctgcagcgagccagacagtgagctggatttatcggccagcaggttgtcgattttcgacatttgttcatagcgcgtggttaagccgctgctctggttttgcgcgccgcgtagctgattagtgataaacgcatcatattcgcgctgtacgcctgaaacgtaaacgccattacctatccagccgccagcccctaacgtactgtttgcctgcgccagaatagttgtctgccgggtataacccgcaacgttataattgttgatgttattactgaccgtatttaacgcggcctgcgcggcgttaagtccgctcatggcgtgattaatcaagctggacatgatggttccttttaatccttcaatactcgttgttatcggcagcgactacgtggacttgagcaatttaaaagagattgtcgagattcgcgctgtaggttttgctgaccttttcactcatcgctttcaactgctgaatcatgctggccaatttacgcgcgtaattcgggtcagtggcgtatccggcgttttgcagagccactgcgccctgctctgccgtggcggcagtggtcacggcagcgtagcgtgggttacgcgttaacagcgcgacataatccgataacgcctccagatacgagctatagacgcggaatttcgctttcacttttttcgcttcgccattttcgtattcagtggtggtgatttccgtcaccggccctttccaactggcggtcgctttcacgccaaatacgttatagctgggttcgccattctcccgcaggatttgccgctgcccccagccggactccagcgccgcctgcgccagaatcagatgatgcggcaccccgctttgttcgctggccagcctcgccgggagcgaaagccgggccagaaagtctttactgtcgccggagagcggcgcatcgctgctgtccggcgttttcggtatggctttgcgcaccagttgggtcagcgcctgattttgatagctgtttaccgtctccagggagaatttaagcggtacttgcggcgcatcatctgcaggcatcgtctgcccgcccgtcatctgtttaaccatcatatccgccagccccaatcccttaccggcggtcatctgctgggcgatctgctggtcatacatgctggtatacagacgcgtctgatcgctgctgaataaaccatctttgggtaaagcctcgcgcatacttttcagcatcatctgcacaaacatcccttccacctgacgggccacaggacggatattcgccgccgggtcctggcccgctttcgctttcagttcgttcagagattgcgcatcccaggccgcgctggccagcaatttaccgtctccgatcatcagatgatttccagtttggcgcgtagacagcccgcgctctgcatggactgcaaaatcgacatcagatccatcggcgtcgcgccaagcgcattcagcgcgcgcactacgctgttcagattggcgctggaacgcacgctctgtagcgatccgccgctctgacgcaaatctatctgagtctgtggcgtcaccacggtctgcccgccgccaaatggcgtattcggctggttgacgttgagttggcgattgactgtcactgacaaattgccctgcgccacagcgcagctatccagcgtgacttcccgattcatgaccaccgaaccggtacgcgagttgatcacgacttttgcatcctgcggcgtcacgttgacttccatattttgaatgtccgccagaaaacgcacctgcgagctgttgccgctgggcacgcgtacctgtaccgttcgcgcatcaagcgcagtggcgctgccgtaaccgcgggcgcggttgatggcgtcggtaatttgctgcgccatcgtaaaatcttcgtcgttcaattgcagattaatggtgttgccagcgccgaactgagtcggcaactcgcgttcgataatcgcgccattagtgatgcgcccgccattaagctggttaacctgcacgctactgccgcctgcggaagcgcccgcgccgccgaccagaatattgccctgcgccagagcatacacctggctgtccaccccttttaacggcgtcattaataacgtcccgccacgcagacttttagcgttccccattgaggaaacgacgacatcgatcgtttgtccctgtcgcgcaaaaggcggatacgacgccgtcaccatcaccgccgccacgtttttcaactgcatattggtgccggtggggaccgtaatccccagttgtgacagcatgttattcagcgtctgggtggtaaatggcgtctgggtcgtctggtcgcccgtaccgtccagcccgaccaccagcccgtagccgatcagcgagttttcccgtactccctggacactggtcagatcccggatacgctcggcgtgcgccagagtggcaaccagtgccagaacgattcctgcaagagctttaaacacatacacctcgcttacatcggcgacaaattaaggaagaaacgttgcagccagcccatattttgcgcttcgttaatatagccgttcccgacatattcaatccgcgcatccgccacctgtgtcgagggaacagagttgctaccgctgatggtgcgtggatttaccacgccggagaagcggatgaattccgttccctgattaatcgcgatctgtttttcccccacgacgtgtaaattgccattggccagaacctgatcgacggtcacggtcagcgtgccgctaaaggtattgctggcattcgcgccgcctttaccattaaaagagttgccgccggaggcctccatatccgcgcgggaattaccgaataatccctgcagataacgcggtaccgtatcaaaaccaaagctggttttgccgtcgcggctggcatttgccgacgagcttttactggcgctgacgttttcctgtaacacaatcgtgagcgtatcgccgatattacgcggtcgacgatcttcaaaaagcggctgatagccataattaatcggctgcgcagactgaaatatggagccattcgccaccggtaccgggccaggtatcggctgcgccgtggtcgccccctgcacgagcggtttagcgggtatccaggcgcatcctgtcagcgtcgcgaccatcagggccataactgggtaagcgtgaagcgcgtatttttgcattaccttcatcttcaaaatcagggagccggtggcgtatcccccaccggcggccccttagagttgcgtcagtttctgcagcatctgatcggtcgtcgatactgctttactgttaatttcataggcgcgttgaacctgaatcatgttcaccagctcttccgccacgttaacgttcgacgtttcgacatacccttgatacaacaaccccgcgccgttgagccccggcgtgctttcgttcggcgcgccggacgattgcgtttcgatatagaggttctcgccgatgctttccagaccggtgtcgttcataaaggtggtcaggttaagctgcccgacctgaaccggcgcggcctgcccttgctgggtaacgctgaccacgccgtcgcggccaatcgtgatgcttaacgcgttggccggaatggtgattgccggctgcacctgaaaaccgcccgccgtcaccagttgaccattctgatccacctggaaagagccgtcgcgggtataggcagacgtaccgtccggcagcatgacctggaaaaagccctgccctttaatcgccacatctttactgttgttggtctgcgacaggttcccctgactgtgcaggcgctccgtggcgaccggacgcacgccggtaccgatttgcagcccggaaggcagcgtcgtctgctcggacgactgcgcgcccggctggcggatggtctgatacaacagatcttcaaataccgcgcgctgacgcttaaaaccattggtgctgacgtttgccaggttattggcaatcacatccatattggtttgctgcgcgtccagaccggttttggcgatccataatgaactgatcataaaatgtcctgtattaactcatcgacagcagttggttagctcgcccttcgttctcatctacgctggtgataaccttcatctgcatttcaaaacgacgtgcgttggcgatcatgtcggtcatggcttcaaccggcttgacgttactgccctccagcacgcccgacataatgcgaattgacgggtcggcggccagtaccgccccgcgttcagcctgtgcctcggcggtaaggcggaataaaccgtcatcgctccgctgcacctcattgccttccgctttgaccagcttcagccgcccaacgggcgccaccgtgtttggcgggtcgccgggattgagcgcggagatcgtgccgtctgccgcaatggtgatttccgacccttccggaacggtaatcgggccgccttcgccgataaccggatgtccctgaatggttaactgcccggtcgggcccacctggatattcccgttacgggtatatccttcagcgccatccgccgcttgcaccaccagccagccgtcctgctgtaacgcaacatccagcgggcgggaagtgtagtccaactgaccctgggtcatatccgcccccggcgtcgacgccgtaaccaacgtgcgcgtcgctaaagagaggccatcaacgggcaccgcgcgtagcgcgttaagctgcgcgcgaaagcccggcgttgaggcattagccaggttgctggccgttaccgcctgctggttaagcgtctggctggccgcccccatggcggtataaattgcgtgatccattaagctatcccgtcaggcgcttagcgcaggttaaccagcgtattgaggatctggtcctgggttttgatggtctgcgcattcgactggtagttacgctgcgcgacgatcatattcaccagctctttactcaaatccacgttagaggcttccagcgcgccgttcgtcagcttaccgaagttgccggaaccggcagtccccagcagcgctaccccggaggcctgcgtcgccgcccagacgttatcgccctgggatgccagaccttcgttgttggcgaagttagccagcacaatctgccccagcacctgctcctgctcgttggagtagttgccaaccacggtgccatcattgttaatctggtagctcaccaggtcgccaggcttatagccgttttgattggtggcgacgatgttattagccccggtgttctgctgcatggagttaaggaagctgagggagaaggtggccgctgtcgcgccattaatcgtaccggtggtgatgttcaccgtaccgccagactccagaatcccgttttcattgaatttcagcgtagtggacgccgttgttggcgcagtggctgcaggatcgctgctgtcatgggtgtacacagcccattcattatctttggttttcacaaaatagacgttcatgtcatgggcattaccctggctgtcataaacggtgacggtgccttttttgttatacgaatccgcatcactcacgctaaagggcgttttagacggtacagggtccgttgagttcaggttgatctgcattgacgcggtggtggtcgatttcgccgccatcagcgtgttcggaatggtgatcggcgcaggattcgccccctgctgaatggtcggcggcgtaccggtggccggatagccggtcaactgcatcccctgcatattgaccaggttacggttctcgtccagtttgaactggccgttgcggctatagaacacggaaccgttgctgtctaccaggcggaaaaaaccgttctggctaatcgcgacatccagcccgcgcccggtgttcgttgtcgtaccgtcggtaaaatcctgggtaatccccgccacttttacgcccaaccccactttggaaccggcgaacatatcggcaaatgatgccgtaccggacttaaagccataggtggcggagttggcgatgttattaccgataacatcaaggttggtggccgcagcgttcaggccgctaaccgcttgagaaaaagacatgactgactcctgataagtgtaagggcttagattatttgccgaacttcgtcgagtgtggtggtgccgtaggtacccagatccaacaggttgccgttactgcccttcgtcacgccctgtaccagagcgaattgcagcggctgcgccaccagttgcgtcccgccattgctggcggtaatcgcaatgttgtaagaaccattcggtaccgttgttccgtccgtttgcttaccatcccaggtaaaggtgtgtaccccggctcgcaactcaccgatctccagcgtccgtaccacccggccatctttatcggtaatggttgccgtcactttgtccgcaggctgttgcaattccacgccaaacggcgtcgtggacgtcacggccccttcttccgcgcctttacccgccagaattgtggtgccaggcaccataacgccatgtccaatcagcgtggtcgcctgtagggactgactattatcgatttgcccggaaatagcccccagcgtcgtattcagtttttcaatgccgctcacggtactgatttgcgccaactgtgtcgttaactcattattttgtaatgggttagtcgggtcctggttcttcaattgcgcgaccagtaaggtcaggaaactgctttgcagatcggcagcgttgcttccggtcatcgacccgctgccggtcgtcgttttgacgcccgtgttggtcgggtcattcatatttacggcaatagacatacgcgcctcctttactggcctaatgtcagcgttttaagcatcatgctttttacggtattcaggacttcgatatttgcctgatagctgcgcgaggctgacatcgtgttgaccatttcgccgaccacatcgacgttgggcattttgacgtaaccattagcgtccgccagcggattgcctggctcataaaccagcttttccggtgcctgactttcaatcacgctggcgacctttaccccgccagtggcttgacccggcgcggcgtccacctgaaaaaccacctgtttggcgcgataaggctgtccgtccgggccggtgacgctatccgcattcgcaaggttactggccgcaacgttcaaccgcttggactgtgcggcaagcgccgatccggcaatatcaaaaatgtttaacagcgccacgaattagtttcctccctgtagcacattcatcatgcctttgagttggctacccagaacggtaagccccatctgatatttgagactgttatccgcaaactgcgtacgttccctgtccatatctacggtgttaccatccaaagaaggctgatcgggtacgcggtaaagcagatccactgcgggagaagagaccgcctgggcgggaatatggcgagaagaagtcaacgacaacgcgacgccgccggtttcttcccgtccgcgcaccatcactttttttaactcactggcaaaatcaatatcgcgcgcctgataccccggcgtatcggcattggcgatattcgccgctaatatttcctgacgttgcgcgcgcagatttagcgcttcctgctgaaatcgtaaggcggcatcgagcctgtcgagcatatctcctccgcaaatggcaaaattcagccgacagcttaaatgccttcacgcgcgcgttatcgccggaataaacgcaaaatgcgtcgctatttattgcgttgatgcttgcttcacacgggtagaatcctgtcatgacatcaaccagggggaagtaccatgcaaacgttaaaacgaggattcgccgtggcggctttgctgttcagccccctgacaatggcgcaggacatcaacgcccagctgaccacgtggttttcccagcgtctggctggcttcagcgacgaggtggttgtcacgctccgttcaccgcccaatctgctaccgagctgcgagcagccagccttcagcatgacgggcagcgcgaagctgtggggcaacgtcaatgtggtggcgcgctgcgccaatgaaaaacgttatttgcaggtgaatgtgcaagcgaccggcaattatgtcgccgtagccgcgcccgtcgcgcgcggcggaaaattgacgccggccaacgtcacgctaaaacgtggcagactggatcagttaccgccgcggacggtactggatatccgtcagattcaggatgccgtcagtttgcgcgatctcgctcccgggcagccggtacagcttacgatgatacgtcaggcctggcgtgtcaaagcgggtcaacgagtacaggtcatcgccaatggcgaggggtttagcgtcaatgcggaaggtcaggcgatgaataatgccgccgtcgcgcaaaatgcgcgcgtgcgcatgacatcgggtcaaatcgtgagtggaaccgtcgattctgatgggaatattcttattaacctataattgtgtaaagattttgtcgcggctgccgatgagatattcaaccatgatggtagctggccgctacaacgtaaccctcgatgaggataaataaatgagcattgaccgtacctcacctttgaaacccgttagcactgtccagacgcgcgaaaccagcgacacgccggtacaaaaaacgcgtcaggaaaaaacgtccgccgcgacgagcgccagcgtaacgttaagcgacgcgcaagcgaagcttatgcagccaggcgtcagcgacattaatatggaacgcgtcgaagcattaaaaacggctatccgtaacggtgagttaaaaatggatacgggaaaaatagcagactcgctcattcgcgaggcgcagagctacttacagaataaataagcgtatgactcgtttgtcagaaatacttgaccagatgaccaccgtcctgaatgacctgaagacggtgatggacgccgagcaacaacagctttccgtaggccagattaacggcagccagctacagcgtattacagaagaaaaaagctcgttgctggcgacgctggattatctggaacaacagcgccgtctggagcagaacgcgcagcgtagcgcaaacgatgacattgcagagcgctggcaggcgattaccgaaaaaacgcagcatctgcgcgacctcaaccagcacaacggctggctgctggaagggcaaatcgagcgtaatcaacaggcgctggaggtgctgaaacctcaccaggagccgaccttgtacggggctgacggtcagacttccgtctctcaccgcggcggtaaaaaaatatctatctaatcattgccggatggcgacgttgcgcctttccggcctgaatgccttgtaggcctgatagcacagcgctatcaggcactgaatttacgccgtccggcgaacaaactctttcactttaaagcccagcacggcaagcgcggcgaaataggccgcgatacccgcgatcactaccgccatcaaacgcagcaaacgccatagcatcgacccttgcgaccactccggcataatatgcaacacgccgaacaacacggcggccattaccagtacggaaatgatcagacgcatcaggaaccacatccaccccggttgtggcgtaaagatattctgtttgcgcagttgccagtacagcagcgacgcattgagacatgccgccagaccaatagagagcgacagcccggcgtgtttcagcggtccaataaacgccaggttcattaactgcgtcatgattaacgtcacgatggcgattttcaccggcgttttaatatcctggcgagaatagaagcccggggccagcacttttacgacgatcaagccaatcagccccaccgaataggcgattaacgcccgctgcgtcatcgccgcatcaaaggcggtgaatttaccgtactgaaacagcgagaccgtcagcggcttcgccagaatgcctagcgctaccgcgctcggcaacgccagtaaaaagcacaaacgcagcccccagtccatcaggcggcagtactcatcatgattgccgctggcaaagcttttcgacaatgacggcaacaggatggtccccaacgccacgcccagcacgccggacgggaactccatcaaccgatcggcatagtacaaccatgagaccgagccggaggccagaaacgaggcgaaaatggtattgatgataagggagatctgactgacggaaacgcccaaaatcgccggccccatctgtttgaccacccgcatcgccccggtgtcgtgaaagttaatgcgcggcagcaccagcataccgatctttttcaaatacggaagttgatacaccagttgcagcacgccgccgacggtgactgcccaggctaacgccagcaccggcggattaaagtatggcgcggcgaataatgcaaaaccgatcatactgatattaagaaatgtcggcgcaaaagcgggaatagagaagcgattccaggtgttgagaatggcgccaaccagtgaagccagcgagatcagcagaatatagggaaacgtaatccgcagcagttgcgtcgtcagcgcaaatttatccgcagtatcggcaaaacccggcgcggttaccataatcacccacggggcggccagcataccggccaccgtcacgacggccaatgccagcgtcaacaggccggaaacgtaagcgacaaagatccgcgtcgcttcttcaccctgcttgctcttatattccgccaggataggcacaaaggcctgagaaaaagcgccttcggcaaagatccggcgtagtagattgggaagtttaaacgccacaaaaaaggcgtcggtcgccatccctgcgccaaaaattctggcgacaatcgcatcacgggcaaagcccaacacgcgtgaaaacatagtcatcgagctgacggcagccagcgatttcaataaattcatttcttttgtattccagaccctggcgtaaaactcctgcatggctgatccatcgaccggataacgcaacttctgccgtatccggctgtatcactgcgcctgacggcgacgtcaaaacgtcttatcaggccttacagactccccacggtttgccattattcactgtgaaaagaggtattatgtagagtgggcatatatacccgccatacttcgagctgcatgtgcgttagcttttctgcaactcgaattattgagggtatagtacctggattacgatgaattactaccgccagatgttacagaggattattcgctgatggcgtcccgccacagcgcctccacgacgcgctgggccaaaatcgcctgctcccccgccgtttccggaaccgtctgattttgtacgcagtcaatgaaatgccgcgcgcatccgacaaaaccacgctgctcaagcgttgtttgccaacccggaatgggtttgatgagaataccctgcccgcgctcttcgcgccattcacgcatatccgtcacgtcatacagcccgccatcggtgacggcctggaccgattcacgctgacttccggcgcgccggtgcatactggtggtaatttgtaatttgtcggcggaaaaatgatgttccgcatagcacatttcgccggactcgctggtgagcaacgtgccgctggcaaggcgcgcctcgccgcccgccagccacagaacggtatccacgacatgcagatagtcatcgagcaaagtaaaacgtaagtcatgcggcccgatgctatcggtacgatgtttatccatacgcagtgacgccgcagtgccgaggcgcgtcttcagttcgcggtacagcggcgcgaaacggcgattaaagccaaccatcagcgtcaattttttttgcgccgccagcgccaccagccgttcggcatcacgtagattttccgccagcggtttatccacgcagacatggacgccagcgttgagaagttcgctgaccacggcataatggcttgcggtactggagtggacgaagaccgcatcgcagccggacgctaaattcgccagcgaatccacatacggtatgcgccagctttcgcaaatacgtaaggctttatcccgcgaaggagaccaggcgccctgtaacgtccatccggcggtgttggttaataccggcagccaggccttctgcgcaataccacctaacacgacaatgccaatccgtaatgttctcacattactctcccaggtgagctaacaaagaatccagccgctgctttaactccgccacttcgctttccagcgcttcgacgcgcgactgaagatcgcccgacgcactttccggcgcagacgtctggagagacagttcatcgacgtcgccgcaaaaaaggtgcatatagcggctttcgcgcttacccggttcacgcgccagacggacgacatacgggccgtcctcacgactggcaagccgttccagcgtggattcaacttccgccatatcgctgaattcatgcatccgcgacgcccggctacgcaactcgccgggcgtttgcgcgccgcgcagcagcaacgtagtgacgagcgccacttccgccgcgctaagtttcagatcgccaaattcggaattacagaagcgctgttcatatttggtgacgcggttgccaaacccgctgaccgtacgcaaaaagtggcgtttcaccaggttatcgagctgttcttgtacctcttgttccgtcaggttcatcaccggttcacggttggttttctgattacaggctgtcaccaccccgttgacggaaagcggatactgttccggcgttgtcacctgcttttccagcagacagccaatcactcgcgcttcagtggcggttaattcatatttcatcgttttctccctttgcctctcattccgtaagccgctcaacgccccggcgtccataacggcgtggttaacgccgtcaggacatggtcgcgccattgtccatcaatcaacaggtaatctttcgcatagccttctttttcaaagccaagccgcgccagcaacgcgccgctacgtttgttgtgcggcatatagttcgccatgatacggtggatatgctgagtgcgctgcatatagcgaatcgcagcggttaaggcttcaaacatcagcccttgcccctgccactcttgcgcaatggaatagcccagataacaggcatgaaaagaaccgcgcaccacattggaaaaattcgccacgccgataatttctttttcttccggatcaagtagcgcgaaatagaaggcggagccctgtttgtgaaattcaccgatcattcccagacgcgcctgccatcctgaaggataacaatgactttcatcacggaccggttcccagggttttaaaaaatgacgattttccgcgtaataatcggccagacgccaggcatcacgctcatgcactaaacgtaccaccagacgatcggtggttaagcgcacttttggcacgttactgcgatagccaaacattctatacctactccttcctgtaacgtcttcagcacgccagtaacattactatacctgcgcaaccaggccctgtgaaaagcgcaaatcgtcattttttgaattgctgccacattttgatgaaaactctcgattaaaaaggacttttgataaaaaaatattgtcccgctaacggtaggaaaaaacgaaacgccgccgcagaatagaagacgctcatcttttatttcccgggaggggaaatgtcgcgcgtctcgcaggcgaggaacctgggtaaatattttcttctcatcgataacatgttagtggtgctgggttttttcgtcgtcttcccgctcatctctattcgctttgtcgatcaaatggggtgggctgccgtaatggtagggatcgcgctcggcctgcgtcagtttattcaacaaggtctgggcatttttggcggcgccatcgccgatcgctttggcgcgaaaccgatgattgtcaccggtatgctgatgcgcgccgcaggctttgccaccatgggtatcgcgcatgagccctggctcttgtggttttcctgctttctttccggtctcggcggtacgcttttcgacccgccgcgttcagcgctggtggtcaaattaattcgtccggagcaacggggccgcttcttctctctgttgatgatgcaggacagcgcgggcgcggtgattggcgcgctgctgggaagctggttgctacaatacgattttcgcctggtctgcgcgacgggcgctattttgttcatattatgcgcccttttcaacgcatggctgcttccggcctggaagctatcaacggccagaacgccggtgcgtgaaggaatgcgccgcgtcatgagcaataaaaggtttgtcacctacgtgctgacgctggcgggctactatatgctggcggtacaggtcatgttaatgctgccgattatggtaaacgatatcgccggttcgcctgctgccgtgaaatggatgtacgctattgaggcgtgtctctcgctgacgttgctctacccgattgcccgctggagcgaaaagcgttttcggctggagcatcggctgatggccggtttgctcgtcatgtcgctgagcatgctccccatcgggatggtgggcaatttacagcagctttttacgcttatttgcgctttctacatcggctcggttatcgccgaaccggcgcgcgaaacgctcagcgcgtcgcccgcggacgcgagggcgcggggaagctatatgggctttagccgtctgggattagccattggcggcgcgattagttatatcggcggcggctggttgtttgatatgggtaaagcgcttgcgcagcctgaactaccgtggatgatgctcggtattatcggctttatcacctttttggctttaggctggcaatttagtcataagcgcacgccgcgccggatgctggaacccggcgcctgatttgatacctgtcgctatctcctccatactggtcaggaaccgacagtcaaatggaggagaaacgtgaagctttatatttacgatcattgccctttctgcgttaaagcccgcatgattttcggcctgaagaacatccccgttgaacttaacgtgttacaaaatgacgacgaggcgacgcccacccggatgattggtcaaaagatggtgcccatcctgcaaaaagatgatagtcgctaccttcctgaaagtatggatattgtacattatgtcgacaacctcgacggcaaaccgctgttaaccgggaaacgtaatccagccattgaagagtggttgcgcaaagttaacggttacgttaatcagctactgctgccgcgatttgcaaaatccgctttcgatgaattttctacccctgcggcgcgccagtattttatccgcaaaaaagaggcctcatctggcagttttgacaaccatcttgcgcactctgccggactgattaaaaagatcggcgatgatttacgtttgctggataaactcatcgtacagcctaacgccgttaacggcgaattatcggaagatgatattcatctgtttccgcttctgcgtaatctgacgctggtcgccggtattcactggccgacaaaagtcgcggactatcgcgataatatggctaagcagacgcaaattaatttactctcctcaatggctatctaacgcccgccaggcggcaaccctttcttgccgcctttttcagctttttttagtggcgccatgtccgctggcgcgacatgctgctttgtgtcaagattagggcacaggcaacatgctaaggaacgccatgaaaaagttttttttgccgctgcgctggtagttagcggcctgttagtgggttgtaatcaacttacgcaatacaccattagcgaacaagaaatcaatcaagcgcttgaaaaacggaataatttctcaaaagatattggtctgcctggcattgccgacgcgcatatcgtattgactaaccttgccagccagattggtcgggaagagcctaataaagtcacccttactggcgatgccaggctggatatgaattccctgtttggcagtcaaaaagcgacgatgaaactcaagctaaaagccctgccggtctttgataaagaaaaaggcgccatctatcttcaggagatggaagtagtagacgccaccgtgacgccggagaaaatgcaatcagtgctacaaacgctcctgccctatttaaatcagtctttacgtagctactttaaccagcggcccgcttacgtgttgcgtgaggacagtagtaaaggcgaagcgttagcgaagaaactcgcgaaaggcattgaagttaaacctggtgaaatcgttattcctttcaccaattgatttcggagggcgcgctcgcgccctttttttacgtgcaaacgaaaacgtttccgcttatcctttgtttccggcaaaaagactattcctcagccggagcttattaatgactgcaccatcccaggttttaaagatccgccgcccggacgactggcacgttcaccttcgcgatggcgacatgttaaaaacggtcgtaccctataccagcgaaatttatggtcgcgctatcgtgatgccgaacctggcgtcccccattacgaccgttgatgcagcgatcgcctaccgccagcgtattctcgatgcggtgcccgccgggcatgatttcacgccgttaatgacctgctatttaacggattcgctcgatgccgatgaactggagcgtggtttccatgaaggcgtgtttactgcggccaagctttacccggccaatgccaccactaactccagtcatggcgtaacgtcagtcgacgctatcatgccggtactggagcggatggaaaaactcggaatgccattgctggtccacggtgaggtgacccatgcggatgttgatatcttcgatcgcgaagcgcgttttatcgacaccgtaatggaaccgctacgccagcgtctgaccgcgcttaaagtggtctttgaacacatcacaaccaaagatgccgcgcagtatgtacgtgacggcagctacaacctggcggcgaccattacgcctcaacatttaatgtttaaccgtaatgatatgctggttggcggcattcgtcctcacctgtactgtctgccgattctgaaacgcaatattcaccagcaggcgttacgcgacctggtcgccagtggttttacgcgcgccttcctggggacggattcagcgccgcattcacgtcatcgtaaagagacccgttgcggctgcgccggttgtttcaacgccccctccgctcttggcagttatgccgccgtgtttgaggaaatgaacgcgctggcgcactttgaagcgttctgttcactgaatggcccgcaattctatggcctgccggtgaatacggggtgggtggaactggttcgcgatgaacaacagataccggaaaatatcgcgctggctgatgattcgctggtgccttttttagcgggtgaaacagtacgctggtcagtaaaaaaataaaaaatgcgcttacctgttgctatatattggatttaactgtatatatatccagtatattcaacagggggccattatgcgtattgaagtcactatagccaaaacgtcacctctgcctgccggtgcgattggtgcgctggcgggcgaactctcccgccgtattagccatcattttcctgagaatttgggtaacgtcaccgtgcgttacgctaccgccaacaacttgtccgtcattggcgcgtcaaaagaggataaagaacgcattagcgagattctccaggagacctgggagagcgctgatgactggttcatcaatgaataaaaaatgatatgcagtgatgtatgtttgccgggtcgccccggcttttttatttgcgcaactgatgaatatttcgcctgaccgtcaaaataattgcacaacatcctaaaaaaatatgaatgaactgccgctttattgttcatataattcttaaaaagagaaatttatcctccggtctctttaaaaacgcagtgaatagccttattaattggtatactgaagttgcttcagaagaaaaacacgcattgaacctcgagaaccgttgtcttataacacgtaccaggggggcatgatggaaaagaataatgaagtcattcagacccatccgcttgtaggatgggacatcagcaccgtcgatagctatgatgcgctgatgctgcgtttacactaccagaccccaaatcgtccggaaccggaagggactgaagttggtcaaacgctctggttaacgacagatgtagccaggcaatttatttcaatattagaagccggcatcgccaaaatagaatcaggcgattaccaggaaaacgagtatcgtcaccattagcgtgacgcgctccccctctctcaggcaccgtaaggtgcctcacttatttctggcttgtatatctcagcgcagttatttaccttgaaatcatcgcgatagcagagagaagctgatgaaatacgaccttattattatcggcagcggttcggttggcgccgccgctggttattacgccacccgcgccgggctaaaggtcctgatgaccgatgcgcatatgccgccttatcaacagggcagccaccacggcgatacccgtcttatccgccacgcttatggtgaaggcgaaaaatatgtcccgctggtgcttcgcgcccagacgctttgggatgagctctccacacacaatgaagagcctatttttgtccgctccggcgtcgtcaacctcggcccggccgattccgctttcttagccaacgtcgcacgaagcgcgcaacagtggcaattgaacgtcgagcgcctggacgcgacggccctcatgacgcgctggccggaaattcgcgtgcccgataattatatcgggctgtttgaagctgactccggtttcctgcgcagcgaattagccattaccacatggcttcgtctggcccgagaggcaggctgcgcacagctattcaacagcccggtaagccatattcaccatgatgataacggtgtgacgatagagacgagtgaaggctgctaccacgccagcaaagcgctgattagcgcgggcacctgggtcaaaacgctggtaccggagctgcccgttcagcccgtacgtaaagtttttgcctggtttaaggcggatggacgttacagcactaaaaaccgctttccggcctttaccggcgaaatgcccaacggcgatcactattacggtttcccggcggagaacgacgagttaaaaatcggcaaacacaatggcgggcagcgaatacaggcaccggaagagcgcaagccctttgccgccgttgccagcgatggcgcggaagcatttcctttcctgcgtaacgtactgccgggtatcggcggttgtttacatggggcggcatgtacctatgataattcgccggacgaggattttattatcgatacgctgcctggccatgagaatacgcttgtcatcactggactcagcggacatggttttaaattcgccccggtgttaggagaaatcgctgcggattttgcgttgggaaaaacgccctcctttgatctgacgccgttccggctttcccgttttagccaataatttgtcggccccgtaaaggggctgtttattaaggtaagctatgcgtcgtctctttcattttctgatgaataatattcgcgaacatttcatgctttacgttattctttggtcgctgctggcggtgatggatattgtttatctccttttcttctgattgcttttcattgacgttaactaacacttcctgaaagttcctcactttttatttcataatgttgaagcacggcaataatgccaactcctgccgttgtgcggttacaggagtgaaatatctcgaaacttctgaagctgaatcgcaaacaacatcaaaattattgaaataaaaataaatatcattcaaattcttatttataagttgcattcggcgcttttccacgccattttcattctctcgtgaaatattcattggtgtgtttatgcaatttaaaaatactccacaacgttatggcgtagtttccgccgccctccactggctgaccgccctagtggtctatggcatgtttgcgttgggtttatggatggtcacgctcagttattacgacggctggtatcactaggcgccggaaatacataaaagtattggcatgttactgatgatggcgctgatcgtgcgtattatctggcggctttattctccgccgcccgttgcgttgaccagctattcccgtttaacgcgcattggcgccgccgcgggtcatatccttctgtatctcctgctctttgcgataatcattagcggctacctgatttccaccgccgacggtaaaccgattagcgtctttggctggtttgagattccggccacgcttacggacgcgggcgcgcaggctgacatcgccggaacactgcatctgtggtttgcctggtcgctggtcattatctcgctctcgcatggggttatggcgctaaaacaccatttcatcgataaagacgacacactgaaacgtatgacaggaatgtcgtcatctgactatggagctcaaaaatgaaaaaaaacctgctgggattcaccctcgcatccttgttattcacgaccggttccgccgtggcggcggagtataaaattgataaagaaggccaacatgcgttcgtcaatttccgcatccagcatctgggctacagctggctatacggcacctttaaagatttcgacggcacgttcacttttgacgaaaaaaatccgtcagcagacaaagtgaatgtgaccattaacaccaatagcgtcgacactaaccatgccgaacgtgacaaacacctgcgtagcgcggagtttcttaatgttgcgaaattcccgcaggcaaccttcacctctaccagcgtgaaaaaagagggcgatgaactggatattaccggcaatctgacgctcaatggcgtgactaaaccggtgacgctggaagcgaagctgatgggccagggcgacgatccgtggggcggtaagcgcgcgggctttgaggccgaaggaaaaattaagctgaaagatttcaatataactaccgatctcggcccagcctcacaagaggtggagcttatcatctcagtagaaggcgttcagcagaagtaacgcctggcgaaatgccggatagcagcctttacgccgctatccggcaaaatattactcagccggatcgggaatgctcagtttgctattaagccgaccccgcgatttattaaaaattttgttgccgttctcacgacccgcgcgacgtcggcgctgttcttcctccggcaaggccaactcttcacagcattgttcactacagcagccgttaaatttactggcgcactgcggacactggataaacagcagatggcaaccgtcgtttttgcagttggtatggctatcgcaggacacgccgcactgatggcaatgcgcgataacctcatccgagatgcgctcgcccattcgctcatcaaatacaaagtttttgccgataaagcgaacgggaagcccctgctcgcgcgcgcgacgggcgtactcaatgatgccaccctcaatatgccagactttattgaaaccgttgtgtttcatccaggcgctggctttctcacaacgaataccgccggtacagtacatcactatctttttatctgcatgttcccgcagcatttcaaccgcttttggcaactgttcacgaaacgtatccgccgggatttccagagcattttcgaaatggccgacttcatactcatagtggttgcgcatatcaataaagaccgcgtcaggatcgtccagcatcgcattcacatctgccgccttcagataatcgccgacattactggcgtcaaaactcggatcgtcaataccgtcagcgacgatacggtcgcgaactttcatacgcagcacccaaaatgactttccgtcatcctccagcgcgatatttaaacgcaccccgtccagcgcggggtcgaacgtataaagctgttgacgaaaggtctcaaccttgctttgcggcacgctgatttgcgcattgatgccctcatgcgccaggtaaacgcgaccaaaaacgtccaacgccgtaaacacctgatacaacgcgtcccgcgtctgttgcggcgaggcgatagtgaaatatttataaaaagaaattgtcgtacgcggctcgctttccgccagcattttggctttcagctcgtcattagagatgcggttgtgtaacactggcatggtgtacgtatcctgcaatcagcaaaaaataaagtgggcaggcatgataaggcaagtctcgccaatttacatccacacattttgcgctacatttcctgctttacgctaaataattaacaacaattgtcgatttaatcgccactctcctgctacatatttttgctcaacgcaaaaagatgcgagaatacggagaattgttcgttgaaagacaggatagaaatgacgaagttgcctaagttctccgtggccttactgcacccgcgctattggttaacctggttgggtataggcgcgctttggttggtcgtgcaactcccctacccggtcatctataaattgggttgcgcattgggccacctggcgcgacgcgtaatgaaacgccgcgcgaaaatcgcctatcgcaaccttgaattatgctttccggaaatgagcgcgcaggaacgccacaccatggtggtcaaaaactttgaatccgtcggtatgggcgtgatggaaaccggcatggcctggttctggcccgatcggcgagtgaaccgctggatggaagcgagcggtctggagcatatccgtgaagttaaggcgcaggggctggggttcattctggtaggaatacatttccttacccttgagtttggcgcccgcatgtttggtatgcataacccgggtatcggcgtttatcgcccgaatgataatccgttgctcgactggttacagacctgggggcgcttacgctccaataaatcgatgttggatcgcaaagatctgaaaggtatggttaaggcattgaaaagcggcgaattgatctggtatgcgccggatcacgattatggcccgcgcgccagcgtctttgtaccgttattcgccgtcgaccaggccgctacgacctccggtacctggatgctcgcgcgcatgtctaaagcctgtattatcccctccgtgcctcgccgtaaacccgacgggaaaggctacgaactgatcatccttcctgcggaatattcgcctccgctggagagcgcagaagcgactgccgcatggatgaataagattgttgagcagtgcattatgatggcgccagagcagtatatgtggctgcatcgccgctttaaaactcgccctgaaggcgtaccgtcgcgctattgacaggattgcagccgtcaggctgcaatttttcccctcttttagctttaaaagctccccacattgcgaggctggtaaggtcggcgcataattataattagtacgctcataattaaattgatgatagcgcaaaacgcgcatcatactgtggaacactatgtcaccctctgatgtccccataaactggaaacgcaatctaaccgttacctggctgggctgttttttaaccggcgcggcattcagtctggtcatgccttttctccctctctacgttgagcaactcggcgtaacaggccatagcgcgctcaacatgtggtccgggctggtctttagtattacgttcctcttttcagctatcgcttcccctttttggggcggtctggcggatcgtaaagggcgtaagatcatactgttgcgttccgctctcggcatggccattgtgatgctgttaatgggcatggcgcaaaatatctggcaatttctgatcctccgcgcgttattaggcctgctgggcggatttattcccaacgccaatgcgctcatcgccactcaggtgccgcgccacaaaagcggctgggcgttagggacgctctctactggcggcgtcagcggcgctctgcttggcccacttgcgggcggtctgctcgccgaccattacggccttcgcccggtcttttttattaccgccagcgttttgtttatctgttttctgctcaccttcttttttattcgcgagaatttcctgccggtgagcaaaaaagagatgcttcacgttcgggaagtggtcgcctcgttaaaaaatccccgcctggtgttaagcctgtttgtcaccacgctgattattcaggtggcgacggggtctattgcgcccatcctgacgctctatgtgcgcgaactcgcgggaaatgtcagtaatattgcgttcattagcgggatgatagcgtccgttcccggcgtggcggcattacttagcgccccccggctcggcaagctcggcgacagaattggcccggaaaagatccttatcgtcgcgctgattatttccgtactgctgctgattccaatgtcttttgtgcaaacgccgtggcagctcgcgctattgcggtttctgcttggcgcggcggatggcgcgctgctgccagccgttcaaactctgctggtttacaactctaccaaccagatagccgggcgcatattcagttacaaccaatctttccgcgatatcggcaacgtcaccggccctctcatgggtgccgcaatttccgcgagctatggcttccgcgccgtattctgcgtcacggcaggcgtggtgttgttcaatgctatctattcatggaacagcttacgacggcgcagactggcaatagaatgatttttgcgctttcatacttgcaatatcacagaatcagctattctttccctaaatacctcgtcaaatcaaagggagacactgatgaccatgtatgccacgctggaagaagctatcgatgcagcccgggaagaatttctggctgaccatccaggcctcgaacaagacgaagcgaatgtgcagcagttcaacgttcagaaatatgtactgcaggatggggacatcatgtggcaggtcgaatttttcgccgatgaaggtgaagatggcgaatgtctgccgatgctgagtggtgaagccgcacagagcgtgtttgacggcgattatgatgagatagagatccgccaggaatggcaggaagagaatactttgcatgaatgggatgaaggggaattccagcttgaacccccgcttgataccgaggaaggccgtactgcggcagacgaatgggatgagcgttaattactcataaggcccgtggtgaatatcgagcggcagtagcagtgtatcgaagatcagtgagaagggcagatcgaggatagtgatatagcgccatgcggaatcacgcatatcccactgcacgccagggtaatactggttgccgtgtccttgtccggggatcgttctgctgataatactgccgcagccgctcagggtaatcaccattatgctcaccgcgaatatacgcacctgatacctcatttcactataaaaataccggcatcacgccggtatttttcacctcactccagacctgaagaccttatcccgctgacgatgttcgtccctgcaacgcctgcggattcaggacgagagactgataatggtttacccaggaagagtatctctctggcgcattccagacccgatagtgtaaacgcgccatcgtcaccggatcgctgagcaaaaccagacgccgatcgcggttcagtttctccggcgtttcgtttagcgcctgctccacatgacgatcgcgggctatttccagcaccttactggcgcggtgacgcgcggtggccatcgcggtcgccagcgcattaagcgacgggttaaataccgcatgcataaagccatcgtccagaatacggcggcgattcatctccagatatttatcggtatcgaccaacacctgaggcggcgaatactcttccgggatcaggaacagcttccagcgtttggtgcgtaatcctaccgttgaacgactggagatcaccgaaacaaatggcgacagaatcagcgaaaagacaatcggcgccagccagaacagaaagcgtaaatccagccacgccatacccaccgcccagaccagccccagcagcagttgagagccgtgacgcataaaggcttctccccacggcgtagaatcatcgtcgcgttgcggtgagttccagaccacttcccagccgaggaacgcgctgaccacaaacacggtatgaaacagcatacgcaccggcgccagcaacacggagaacagcacttccagcaatagcgacagcgtaacgcgccagaaaccgccatactctttggtgcctttacaccagatcagcataatactgagcagcttcggcaggaacagcagcaccatcgttgacgcaaacagcgcgattgccagttccggacgccactgcggccagaccggaaaaagctggcgcggctgaaggaaatattgcggctctgttaacgcatgaacgacctgcagcgcggtagaaagcgcgaggaacataaaccataacggcgcggacaggtatgacattaccccggtcaggaacacggcgcgatgcaccgggtgcattcctttcaccaggaacagacgaaagttcatcaggttgccgtgacaccagcggcggtcgcgtttaagctcatccagcaggtttggcggcagctcttcataggagccggggagatcgtaggcaatccagacgccccaccctgcccgacgcattagcgccgcctccacaaagtcgtgggaaagaatcgatccggcgaacgaaccttctcccggcagcggcgccagagcgcagtgctcgataaacggcttcacgcggataatggcattgtgcccccagtagtgcgactcccccaactgccagaagtgcagcccggcggtaaacagcggtccataaacacgggtcgcgaactgttggcagcgggcatacagagtatccatccccgacgctttcggcgaagactggataatcccggcgttagggttcgcttccatcaggcgcaccagcccgctcagacactcgccgctcatcactgagtccgcgtccagcaccaccatatagctgtactgattgccccagcggcggcaaaaatcgtcaatattgccgcttttgcgtttcatacggcggcggcggcgacggtaaaaaatttggccttcgccctgcacttccgcgatgagctccatccacgccttttgctccgccacgcagatatccgggttataactatcgctaaggatatagacgtcaaaatgcgcggcgttgcctgtggctttaacggactcccaggtcgcgcgcagaccggcgaaaacgcggctaacgtcttcattacagataggcatgatcagcgccgtctggtgttccggattgaggggctcatcgccaaccgtagacgcggagatactgtacttatcgcgcccgataagcagttgcaggaagcccatcagcgccgtccagaatccggcagacacccagcagaacagcacggcaaacaaaatcaggataccggtttgcagcatgtagggcaggagctgcataaaggagacccaaatatcctgccccaccatatccataggattgatgagcgcccatccctgatagggcagaatggtcttcatataccaggtcgcgacgacggtttgcgccagagtcaaaattaacaaaatatagcggcgtatagtgccgacggtacgccatttttgctcactcgcctgctcttcttttgtcagacgagaaacatagcgcggcgttacatcccgcccacgcaggcgatcccagaaacggccaaccgggttggttcgccagggatcaggaaacatcgaagagcgcgtcgcttttggcatagcctgcaactgatcgcgcccttcatcatctttaattaactgccccttcgccaatgaatccggccaggcgtgttcaaggcgggcttttacggaaccctgcggtgaatcgtcttctcgcgagtaagtccgatgctcggcatccagcgcctgatgcacggcgcggatgtcagttttcggcaatgccgctttctcacgttcagaaagcagcagtgcgtcaatatactcagttgttttattcattggcaggtaactggtagctccaggtttcacttagcgtctgatcggcattcaccaatgcggcacgcatttccgtggttttcttcgcgtctttgactttcacgcgcagcattaaacgccagcctttagtgactgggttatagcgtacattactgtcaacgatttcaccgttatcgccaatgctggtttgtgcagcgacgggcgtatccggcggcagttttttcatgtcggcgccaacgaaatccaccacaaaggcaatagtgccgtcgggctggcgaatcagattcgactgtttaacgtcgcccgttgagcggcgtgtttgcagcacccaggcattatccggcgcatgaagtttatcttcatcgcggctgaaggtcagagtgtacttgaagttcatctctttacccggttccggcagttgatccggagtccagtaagcgacgatgttatcgttggtttcatcattggtcggaatttcaaccagttcaaccttacctttgccccagtcgcctttcggggtaatccaggcgcttggacgcaggtcatagcgatcgtctaaatcttcaaagcgcgagaactcgcgaccacgctgcaacaggccgaatccctgagggttttccatcgcatagctgctcacagcgaggtgttttggattgttcagcggacgccaaatccactcgccattacccgcatgaatggataagccgttcgagtcatgcaattccggacgatagttggtcgtcggcgacggctggtttggcccaaacaggaacatactggttaatggcgcaacgcccagcttgcccaccttatcgcgcagatagacttttgactgcacgtccaccacggtatcgcggccaggaatgatcacaaaacggtaagcgccggtcgcgcgcggagaatccagtaatgcatagacggtcaaacgcttatcggtgggttttggacgctcaatccagaactcgcgaaagcggggaaactcttcaccagatggtaaggcggtatcaatcgccaggccgcgcgcagataagccatacacctggcctgcgccgataacgcggaaatagctggcgccaagcatactgacgatttcgtcgttcttatctttactgttaatggggtacaggactttgaacccggcgaagcctaaatcttttaccgtgtctttatcgtgctgaacattgccaaaattgaagtaatccgggctgtatttgattcttttgaccgtcgtcgccgtcacttcgttaatcttgaccggcgtatcgaagtacatcccctgatggtaaaattcgagcttaaaaggggtctttaagttgttccagtaggctttatcgctgttaaactggatctgctgataatccgcatatttcatgtcgcggaaaacggagggcaagttgcttttaggcgcctcatagcctttcccggctaaagattgagcttgttttgccacgtcatcaatactgaacgcccagctcgatgatgcgtagagcgttaacataatagctgcgcccaaccaacgcattttcatcatttgtcgtttatgtttcataataagtaagcacttccccctttgtgtgcttatatcgatccgatccattttaatggataatcaggcattacgacaactgaatccaggctttgttcagcgcgctggctcatggattaagcacctcccgcgcctgttttcactttgcgtgcttatcctggagacaggttgtcggagttggtgtagggttgctaccgaatgtaactataattcgccttatggataaggtgaaaaatctgagaatacgtgaccttatatgagctctgtacccgcgccgcgtgaatattttcttgactctatccgcgcatggctgatgttgttagggattccctttcatatctcgttgatctattccactcacagttggcatgtcaatagcgccgcgccatcgtggtggctaaccctgtttaacgattttatccacgcttttcgtatgcaggtgttttttgttatttctggttatttttcgtacatgttatttttacgttatccattaaaacactggtggaaagtacgggtagaacgtgtgggtattcccatgcttaccgcaatccctttgcttaccttgccgcaatttatcctgttgcaatatgtcaaagagaaaacagagaactggcctacactctctgcctatgaaaaatataatacgttagcgtgggaactcatttcacatctgtggtttttactggtgctggtgatattaaccaccgtcagcatcgggatttttacctggttccaaaaaaggcaggaaacaagcaagcctcgtcccgccgctatttcgctggccaaactttcgcttatttttttcctgctgggggtggcgtacgctgctatcaggcgcattatattcatcgtatatccggcaatcctcagtgacggcatgttcaattttattgtgatgcaaacgctattttatgtgccgttttttattctcggcgcgttggccttcattcaccccgatctgaaagcgcgcttcaccacgccctcacgcggatgcactttaggcgctgccgttgcttttatcgcgtatctgctgaatcaacgttatgggagcggcgacgcctggatgtacgaaaccgaatccgtgattacgatggtaatggggctatggatggtgaacgtggtattttcactggggcatcgcttgttaaactttcagtccgcgcgtgtcacctatttcgtgaatgcttcgctgtttatttatctggtgcatcatcccttaacgcttttctttggcgcgtatattacaccgcatatctcctccaacctgatcgggttcttgtgcgggctgatatttgttatgggtattgcgttaattctgtatgaaattcatttacgcatcccgctcctgaaatttctcttttcaggtaaaccgccggtaaaacaagaaagccgcgccgcgatcgggtagttttccgcgcgcgggttcacagcaaccattccacaggtaaaattgccgccaaccgtaccagaactcgctgccagaaacgcgtagcgggttctttctttaacaccttttcctcttcttgctgacgatcgatccagttaattcgtccccagcgatccagccgcagttgccaggccgcatcgcgttggctctgcgtaaaacgcttatgaataagcgtcgccagcgtttcactttcaatgacaaagcccatttcggtatttaaaagcgttgaacggggatcaaaattaagcgacccgataaacaccttactaccatcaatactgaacgttttagcatgtaagctggaacctgagttcccggtgagtccgcgatcatgtacggcggtttcatgttcgcgggtcggtttcagttcgtagagctccacgccatagcgcagtaatttcttgcgccagcgcgcgtaccctgcgtgaacgaccgccacatcgttggccgccagagagttagttaagatggcgatcttcacacctttcctgaccagattaagcaactgcgccacgcctgcgcgcgtagggacaaagtaagcggaaataatgtcgatacgctccgtcggcgaccccatcacgtcaaataatcgctgcggaagaagcgaatggcgctgcgccttcccctcgcctttagaagggtcatcgctaagcaagcgtgtttttgcccaaatcagcggcaacgttccgcgatcgagatccgccataaactggctggtttccagcttatgcagataacggcgggtgatctcatcgttataccaggattcgggaagttcgatacgctgcgtcagttcctgctcagaaagggataatacttgctgcaatgtcgacactgaactacagcgccagtaacgttcaaaatcattggcgacatcattgaccaccgggccaatggccatcacgtccagatcggaaaatagcggctcctcgccagcgccgaaataggcatcgccgatgttgcgcccaccgaccagcgtcactacgccgtcggcagtgtaacttttattgtgcatccgccgattcagccgcgcaaaatccgtcaaatatcccagcgcgcgtagcgtacgaaaagagaaaggattaaacagacgaacttcgatattaggatggctatccagcaagcgcaacgtatcatccagaccaggcgtattgttatcatccagcagcagacgaacatgaacgccgcgcttcgccgccgacagcagaaccgaaaagagcagccgcccggacatatcgtcttcccaaatataatactgcacatccagcgtccgcgccgccatttcggtcaggcggtagcgggcggcaaaagcgtccagactgttatccagcgcaagaatgccgcactctccgggatggcgcgcgcatagcggttcaacggcacgctccaggcgtgttttatcaggcagggtcgtcgccttgctgagtaagtaatcttgcgtaaagccgggcagtttcttcatcataacagacaaagtatacctgttcaggcagagcgtaacgggtaataaaatctgaaaccgtcctgacggcgacttcagcggcctgggcgcgtggatagccataaacgccggtactgattgccggaaaagcgatggaacgaaagtgattcgcctcggcaagcagcaaacaattccggtatgcctcttcgagtagctcagcttcctggtgttcgccgcctcgccagacgggccccactgtgtgaataaccgcctttgccgaaagcttgccagcaggcgtgataaccgcatgtcccgtctgacattcgccctgttgctgacggatgagtttacaggcgtccagcaatgccggccccgccgcgcgatgaattgcgccgtctacgccaccgccgcccattaatgatgcgttagcggcattcacaatcgcatcgacgctaagttgagtgatatcaccctgtatgacctgaagacgtgatgtcataaccccccccttttgtctcaccttatctgcaaagtgtacagcagggctttcaacagagtcgctctttttatatctatgacaccgccgttaacggtactcaatattcatcaccgccaggcttttttgcgcatcgagataatgcagccgtaccgtcgcaatggactgaatatcctgcggtaatccagatgcctgccgaaggtctatccggtgcatttgctttttaccttcgcgtaggcaggttaaatcaatattttcggcgtgagtagaaatatcgcacagtggctcaacaatcgcgccgcgaaaatggataacgccgccctgtaccgtttgttgccctaccgcagaatggataaaaaaagcgcagatacacaggcctatggcagggatatttttcttgattacggacatgttaactcctcaatgattagtcatcctcgagggttcggcgttaccttttagcgacatgccgagacgatgagacgcttttatcgcctctttaatacccaggtcagccaatccatttccgccaccatcaaaaactactgtgcagaaggcggccattgttgtgataaatgcagtgattgtccgtccgaaacagtaacaataattttaaccgagtcctctgaagatatatttacactaagacgagacaactcaatcggttgattagcaggtaaagatagcgtttgtttttgctgtgtatggctttgtcccccgacgccgtcgcgcacagagagaatttgcaccagacagacgcagggttcgtttaatgtgacctgagggatcaccgtgtaaatatcgccttgctgagtcgtggtaaacgtaatctgatttgaaagtgcggcaaggagcaataaagtatgcataatttcctcccgaaaaaaaacagggcttacgccctgtttttttattagcgcagacgctaaattaatactggttagccgtggcgttgttgccaaaaccaacctgacgcaccattacgctggaatcagatgcggtctgattaaccagcgcggcgttattaccgccgtattgaccgacagtaatatcggagtttttagcgttccactggtcgatggtggcattgtttctgaaaccattctgagtcagttcaatagtactgttatccgcaccctggcctacatcggcgccgttaccataaccgctctgggtaatggtcgtttcagatttacgggcatcgctttgcagagcaagcgcagcgttagcggaaccgtactgataaatgctcaacgtggaatccggcccggaactattgccgccgccgttatgattaccgccgccgccccattgtggaacgacgccagccagagcactgccagaaactacgattgctgcgaatgctgccacttttaaaagtttcatggtaaaacccccatcggattgatttaaaagtcgtaacggtattagcgttgggtgacgcgaatagccatatgcgactgtttctgcactacaactgctgttttctgcgtaccgtactgggtaatattggccttatttccagaacctttctggataatagccgcactattaccgtaagcgctttgcgatatactggcatcgttggcattgcccgtttgctcaatatacgcaaagttataattccctgcctggtcgactttcgcccgattattttctccttcttgtgaaataacggacaatagttttgatccttcctggcgtactctggcactattatccgtgccgacttgaccaataatggccgcctgattaaatgaagacttgcttaattcatttaccgcaaaattatactctgaacgagccagatcataatttgtcgcggttgcaatcccaggcgcacccagtattgtcaacatcataaataacaatttgtttttcatgctgtcaccctggacctggtcgtacatagcgaaaattatctattaccttgttagcgacatgcgttttttgttaacgcgtcgttacgatgaagagtatgtccgtggaaacatttttaataactcacccacgcgtggtattttgttatttaagctcataccaaagtgctaataaaacgatagccatgtgattttttataattgatttttggccacagaagatagtgtatcgcgcacctaaaaaatgaagtgttggtgtgtgttatgccgccatggggatgttcttatgcttcccatggggggcaatacgcacaagacgtgacacacttcgtttttttttgtctttgtgctgtccaggttaatgccacgtctcaaattttaagaaaaaataaaatcaaaacatgacatacaataattaaaatgattaaaaatcaatgaattattataatttgtatgattttttaaatctatgcaataacagcgaaatgtacaactttactatcaaatctaaacttcaaaaaaacccaaaaacaacattttaatatatatttttacatcttgttacaagtttaacacttgctttaagatttgtaatggctagattgaaaacagttaaaagtattttcgtaaatatttttctctttctggataatgggctatttcaacccacagcagtgcaacatctgtcagtacttctggtgcctttattttatgggggcagctgtcagatgtgcgattaaaaaaagtggagtttcatcatgtttaatgaagtccatagtagtcatggtcacacactattgttgatcacaaagccatctctgcaagctacggcattattgcaacatttaaagcaatcgctggccataaccggaaaactgcataatattcaacgttctctggaagatatctcagccggttgcattgttttaatggatatgatggaagcggataagaagcttatccactattggcaggataatttaagccgcaaaaacaataatataaaaacattattgttaaatacccctgacgattatccctaccgtgaaattgaaaactggcctcatattaacggcgtgttttacgccactgaagaccaggaacacgtggtcagcggattacagggtattctgcggggcgaatgctatttttcacaaaaattagccagttacctgattacacactcaggaaattaccgctacaacagcaccgagtccgcattactcactcatcgcgaaaaagagatcctcaataagttacgtattggtgcctctaataatgaaatcgccaggtcgctatttatcagcgagaatacggttaagacacatctttataatcttttcaaaaagatagctgtcaaaaatcgcacccaggcagtttcatgagcaaacgataatctcaggcggtaaggccatgaaacgctatctgacctggattgtagcagcagagttactgttcgctaccggaaacctgcatgccaatgaagttgaagtcgaggttcccggattgttaaccgaccataccgtctcttcgataggacatgaattctatcgtgcattcagcgacaaatgggaaagcgaatacaccggcaatctgaccattaatgaaagacccagtgcgcgttggggaagctggatcaccataacggtaaatcaggacgttattttccagacctttttatttccaatgaaaagagacttcgagaaaaccgtcgtcttcgcattagcgcaaacagaggaagcattaaatcgccgacaaatagatcaaacgctattaagtacgagtgatttagcgcgtgatgaattctaaaacatgatttttatccggaggctgtcatgcgtgttaaacatgcagtagtgctgctcatgcttttttcgccattaacctgggctggaaatatgacgttccagttccgtaatcctaactttggtggaaaccccaataacggttcctttttattgaatagcgcccaggcgcaaaattcatataaagaccccgcttatgataacgattttggtatcgagaccccctcagcgttggataactttacgcaggctattcaatcgcaaattctgggcggcttgttgaccaatattaataccggaaaaccaggacgtatggtgaccaatgattttattatcgatatcgctaatcgcgacggacagctccagctcaacgtcacggacagaaaaacgggaagaacctcgaccatcgaagtgtcaggtttacaaactcagtcaaccgatttttaagctacagtcactaaaggatataaatcatgccgcgcttacttattttggttgccgttttattgttgagcggatgcttaactgccccgccgaaacaagctgcgaaaccgacattaatgccccgcgcacaaagttacaaagatttgacgcacttacctgctcccaccggtaagatctttgtttcggtatataacattcaggatgaaacgggccaatttaaaccttacccggcaagtaacttttccacggctgtgccgcagagcgccaccgctatgttggtcaccgcgctgaaagattcgcgctggtttatcccactagaacgacaaggcttacagaatcttttgaatgaacggaaaattattcgcgcagcccaggaaaacggcaccgtggcgatgaataaccgtatcccgcttcagtcgttgacggcggcaaatattatggtggaaggttctattattggttatgaaagtaacgtcaaatccggcggggtcggcgcaagatatttcggtattggcgccgatacgcagtatcagctggatcagattgctgtcaacctgcgcgtggttaacgtcagtacgggcgagatcctttcttcggtgaacaccagtaaaacgatcctttcctatgaagtacaggcaggcgtgttccgttttattgattaccagcgcttactggaaggcgaaatcggctatacctcgaacgaaccggtgatgctgtgtctgatgtcagccattgaaaccggcgttatcttcctcattaatgatggtatcgatcgcggactgtgggatttgcagaataaagcggacaggcaaaatgatattctggtgaaataccgtgagctgtcagtaccgccagaatcctgatgaatacgacaaagcgtggggaaaaccccacgcttttttattttgtgaccgccgtattcgctgaatgttgctcgcggcgtgatgccagccatagcccactatttttcatggcatagccaaagattagccccagcgccagcgacggtaataccaaccgccagtcaccctgccctgcaaatgtcgcgcaggcgccgataaatgttcccggaacaaaagaaagcaatagctgctttgcctggatacacatcaggaatgccacgatccccgtcaacacgtaactgacaatttccagatgcggcgccaacgcgctaccgtgaataatgaccagcgcccacaccataccgcttaacagcgtacaggcggaaatcaacaatcccttaaagccgccctgcggacaggcgaaataagccgtacagcctaaaaaaccggcccagcttagtaaccccagggagacggccacccatccccatattccagaaaggatgcccgtagtgatagcaatagaaagaagtatgttcatggcgcgcatcataacagaaaagcggcacattaatgagatcacgcacacattttatgcaatgatgcaaaacccgttgcagttaatggtgatttacatcacattattcttcatcttcttcctgaagttcatcccacatggcccctatcgcatcacgcgttagcggcgccagagtgcgccagaatggcgtaacggcatgggcttcaactttaccgaggaaggtattgcaccagggaagcagataatcggcaaataaggtttccagcgcttcactttcatcttcggcagactgatcttccagccaggaggccgcgagcaataaagtgccaatgtgatcggcaggcgtatcggccagcggcatccctcgcgacgttaaaaaagcgcgcacctcagactcttccgcgccttcgacccacgcactgcggtatggcgctaccgcgcactcttccccaacaaataacgcattgtaatcagtggaaatctgcgtgatatcgcagcttttctgtaaacgcgccagcatgtcatcctgctccagcggccagtttgccgccagtttaccttcacggattaacgtaaacagcggaaccagtaaaggatcttgcggttggcggtaaaacaacgatcccagcacacggcacaggattgaaaactcattcattgatatcttcccgtaaataacgattaaagttcggcaaattccggtacaggcgccataccgcgtgattcgagaaaggccagtaagcgctgcggagagacgttcaggattcgatcttccggaaaattcaccgcatccagaattttccggcattcggtgaaatcgccaagcgtaaaggccgtatgggaatcagagcctaacgctacccagcctcccgcatcgcgtacggcggcagcgaccgcgcggcaattatcttcgcttcctttacgcgaatgcagaaaagaagagttgttgatttccagcgctacatggtgtttcgccgccgcctgcgcgatggctttaacctccactggatactttggatttccggggtgactaattatatgcaccttgccgctggcgatggtcgcgatcatcgcctgagtattggtttctttatcatgcggcgcaaaaacgggctcatgaaagcctgcgataatcagatccagcgagtcgaacatctttccggaacaatcaatttcaccgttaatattcttgatattcgcctcaatgccacgcagtatccccacgccgtcaaccagacgcggccagatgcgcatgttaataaaatgccagtgatgcggcgcatcttccatgtccggaccatgatcggtaatcgcaaaaagtttaatgcctttgcgtttggcttccgcgatataatcgctcagagtactgtaggcatgagtgctggcgacggtatgcatatgcaggtcaacgggatacattgctctctcctgtagtcatttccgacaaggatagcaggtatcgccagcgttttttagcgaaacccggcccgcgccgggttgatatcaatatcctctcgcccgatccacctgccccgtcaccggctctcccttctccagctgggtaatggtgcggctaatataatcgatggcttccgccggacgggtgactgccgcaatgtgcggcgtcatggcgactcgcggatggcgccataatggactttcctgcggtaacggttcctggctaaagacatccaacatcgcgccttttagcttaccgctatcaagcgcagccagcagatccgcctcctgaacatgaacgccgcgcgcgagattcagcacgtaagcgccatccggcaattgatccaacaattcgctattaataattcctaccgtttgggccgtattcggcagcagattaatcagcacccgcgtctggttcaggaaagcgcgcagttcttcacgccctacataactttccacgccaggccaggatttgcggctacgactccagcaacgtaacgggaacccccacgcctgtagactttctgccacttttgcgcccagtacccctgcgcctatgataccgacgctaaactcttcgcgggtatattccggcaacggtttccatagcgcctgatttttcagcgcctgataatcatcgaaacgacggaaccagtgtaatacctggctggcggcatactcctgcatttgcaggcccattccggtatcttccagacggaatagaggaatggaggcgtccagcatttccggatgcgcatttaatttactcagaattgcatccacccccgcgcccagcacaaagacggcttttaagcgtcttccggccagcatttcaaccgggggctgccatacaagcgcatagtctgcggggttgttatcaccgaccttccattcacgaacgcgcgcatgtgggagagccttctccagcgcatttacccaccaggcggcgttaaatgtcgggtgataaaaaattatctccatgttatctcctgagcagtattgtgcggaatgtgattgcgcctgttatcagcgttttcaacgggatgtgcagcatagcaaatttcccggcgcgggcaaaaaaagcagttttcgcttattaaagccacagattgatggaagtttgtataaaagcgcttttttttaaaaaagttgattgacgtagaaaggatatttccctacattagcgcccgttccagtaatgctggagcgacaatttggtgaggtgtccgagtggctgaaggagcacgcctggaaagtgtgtatacggcaacgtatcgggggttcgaatccccccctcaccgccatcttcaagttgagagcctgtacagaagtacaggctttttgcttatatgtatcccccaaaccaaggggggatgagaaccaccgaccggggttcgacaactggcgcagccagttggacagaccgggcgcgcagcgaacgggctgcccgaagggcgagcgcagcgagtcaatccccccctcaccgccatcttcaagttgagagcctgtacagaagtacaggctttttgcttatatgtatcccccaaaccaaggggggatgagaaccaccgaccggggttcgacaactggcgcagccagttggacagaccgggcgcgcagcgaacgggctgcccgaagggcgagcgcagcgagtcaatccccccctcaccgccatatttaagaaagagctcgtacgaatgtacgggctttttttcgcattaagcccccgtccattgccggatggcggcacagttcacgggcgccttatccagtctacataagcgcagcgccaccggccaataacaccaccatccggctttaaattttagccaagaatttcagtgagtttaactttgcgcccctcgtttgaagaaagcgtcgcagcatcagcggtagcaatggcatttgtcgccgcttctcccgttagcaatttagcaaactcctcgcctggctccagaccgtttatcacatcatgcaagtactgcatctccagtttcataattgatgagagccacatcggcgtacgtttaccgggtttaccataagcgattgcgccatccatctcgctggatatgttaccgttgcgacgatcatcatcctccgcctggctttcatgcacaagaaagtgtgtttttttgcccgcttttattagataaccagccgtgttttgcatatcaatgagaattgcacctgtcgtgccctcaattaatacatagtgctcagggtagtggaacgatgatccccactgaagtgtcgcgaaacgaccgctttcaaactcaagggtgattaggacaacatcatcttcatcaccaaatttttcacctttgtgcgcaacattccccgccgccattgaaaccagggatggggtttcatccatgatgaacagtgtacaatctagctcgtgaatgtgatggtacagatgcccacctgactttgcgcgaatcttcttccatgagatctcatcctgcacgtcttcaaaaccattacgtttagtgtgaacttgtgtaacttcaccgatttcaccggctttgatgagcgctttagcgtggcgaaccccgtgaaaaaagttcataacgtgacccgccataaaggtaacaccagcttctttgcaggcatcaaccatatccttacaatcctggtaatttaaggcgataggtttttcacaaaacacgtgtttacccgctttagccgccgcaatgaccggcgctttatgtaagtaatttggtgaagcaataattacgcaatccacatcaggatgggtacaaagcgcctccatcgttgaagtggcgacacagttcagctctttcgctatcggagccgcatttaccggatcgtaaatcgcagtgattttcgccccttcaaccttagacataaatcgcgccagttcagcgccaaaataacctgtacctataacaccgtatttcgtcatcatttatcctctattaaaattcttttgttgactgaaacctttcacgacgtgcttttagtctatccggaatggataggccaataatgagtagaattgttgcggtccagaaagcaacaatgaacgttagcgcagcgcctagccccattgttattccaagccaggtcgccgccattgaattgaatgtgcctgatgtcgcagcaagattataaataagcccggtacccaaaccacgaacctcaagaggaaagtagtcgtagagaaatttgggaaccagcccgccaacacctacgttagtcgccattaaaccgaataaacatgcgcccagcagtaaataattatcttgcggaattctgaataacgggaaaatgaataaaaaggacatgagaagaccaatgctgaacgttttcttcaaaccaattctatctgcgcacagaccccaaacgatatttcccaatacagtgccgaatgccgccgccgtcattaaattagagaccacgcccgtatcaaagccctctcccgccaaatatgtaggcagtagaccaaagatcggccagtttgcgccgaaaatagagaacagaacaataaatacacataatgtcagtggaaattgagctcgattaaatagccctttcattgacaaagagaaaactgaccaggcactttgtgaatgctttccgagaccactgagtttggcttcttcccactctttagattcaggagccctggcccggatgtagattactaaaagaacgggtagcaaaccgacaaaaaaagcagcacgccaaccatacgcttcggcaaatgacggcataaaataggctgctatgatgttaccaataccgaaacctgaaaccagaaatgcgctcgctttagattttaaatgctttggccaactttccacggcataagtagaagcgcaagcatacttccccgccatccccataccgacaataaaacgactaagcgtcagcataattacaccggaagccaggccacttaaccctgtacctacagaataggcaactatcgaccacatcattaacggcttacggccaaatttgtctgccagcagaccaaatagcgccccgccaaatggtcgcccaataaaggccgctgtggcaaggaatgcgccctccatatctgtcaatcctaagtcagccttgatcagatacataatgtagaaaatcagcataaagtcgaagccatcaaaaacgtaacccagccatgctgaaaataaagcatttttttgtggacgtgttatctcgctataccacgggaagaattttgctatcacaataaaacccttatttgctgttaccgtctgaaatgcttacggaattaatttttaagtcatatcaattgccgaataagacactatcaaccggcactttccgacaaccgcctgagatcgtagctatgtaaggcgtatattcattgtttatcatccttgttcgtagctacgttaaggacgtgaatactcaagacaaagtctaacgttctgtaacgtagctacgggctataagattatcgatatgaatactaagcaaagattagtacagtaactctttaacctttctcaaaagtggtattgtaatccaacgcgataacgggtctgtctctcatcggtattatttctcaccgctacatttccgacctcaacgtatggtgtaaatgacttattcagtttccaggctaaagccacattatgttcatagtttgtttttttgttatcaaatttaatttgatcgctatccatccaggtaaatttatattccaatttcaactcatcaaaaacataacctatataagtatcaaatctattcgttttctcatcatcattatagttagctgtcttccttgcatagtcataacggtaacgaccagccatataaacaccagaatcaaaattatattgcgcccttaaataaggcttataaattgaagtgtctggaccgctttcaaatataaatccaggctgcaaaacaaaatggtccgtaactttataattataacttacgcccagttctatagcgtttgcgacgagatcgcttaaatgcttatcctgctcaccatctactcctcccgatttaacgctggcatcgacataaaaaccaatgccgttaggaagcttttcaattatagcaatacggtctttattaattctggttctatcagcatattcatgccgataatcaagggttgccgcttgtagatatgatgaaaatgctataaacgaaaccatacccagaagatatctgttgattttcataaaatactccgcttatcaattaactttatttttgtatttaaaaaattattattttaataaattaccatcacgcatggtaaaggaggttacagacgaaacaggtttccctttagcattttcaccaccaataaggaaaacttcatcaccataacttactgatacaccatagccgagaggttgtttcattttacccatatattgccaatggccattaatcaaaccatagacttcatctcgccattttttatttatcccttcgtgggaataaaactttccattagtataattttgttttgctcccggaaaattcgcgccaccaccgacaagcaggacaccgtggctatagcccgaaaatgctccggccaacccttcctgctgttgttctccaggcgatggcggtaactggctgttcttcaaccatgttagcttatcgttatcccacatggcgcggtaaatcacatcggtacgtaaacccggtttgagctcaccattaatcagcatcaagaaattattttccattaccgatgacgatcctgccgtccccgcgcctggcagctcaccggcattcttccatgtgttctctttagcattgtagataaatacgattttattaaaaaaataatctttggcaggtttattaaaataattatagatgactttatttttttcactttcatccgcagccgctatatcaataaaatacttatcaaagatatgctcattaacccctccggtaataagtaccatcgtttcgtttaattttactcccgtatgccctgttaatccaactggagatatagtatcaactttttgccatgtatttttcaccggtgagtatttgtacacatcgctataaacctgcaacggtgattcactgttttttttccctacgccaccaaaaacatacagcttatcatttaaaaataccgacacggattgctcacgagctccaccaggaaacgactttatacgctcccagtctttatgttgctttttaagatcaattttataccaggatgtccctgcggtacctaagccgacataaatcacgccattattatcaatagcgccagtaccatttttcagtggttctggtatatcaggaagcgtggttgcatatcctgatgtggtgatagcaactgataaacatagcgccattagcgtcatcattttcttaaaatttttcatctgcatccccatgcgaagaaatacaactggagtaaagcttcatcattagtgatcttatggtgcataatttcaacaatgaaaatgacaaaatgtgaccaagcgctaaaaataattacatggggttaccatgtgcgaggtaaaagcacactatggtgatgttagaagtgattatgggtgacctgttatgggcaaactcattagtgattgcattctgaataaatacaacaagaattatgtgatgcatttcatactggctatcccgtggcgtataagctccttctgagcattttatctttatgccggaagcagttaataaaatacagcatgctgccgtcagaatgaattgtatttgtcttgtagcttcaggttatagcctcaaatccgctggcgcagtaattgaatgacaaacataccttatgactgtgttcacatttttctatctttttgcttgatgcagcaacactccacaacataatataaaacggagtaaaacttcaaaatatataaggcggaactggatgtcactattagccaggctggaacaaagtgtacacgaaaacggtgggctgattgtctcatgccaaccggtaccaggcagccctatggataaacctgaaattgtggctgcaatggcacaggcagcggcttcggcgggtgcggtcgctgtgcgcattgaaggcattgagaatctgcggactgttcgtccccatctttctgttcctattattgggataattaaacgtgaccttacagggtcgccagtccgtatcactccatatttacaggatgttgacgccctggcgcaggcaggtgccgatattatcgcttttgatgcctcattccgctctcgcccggttgatattgatagtttactgacacgtattcgcctgcatggattactggcgatggcagactgttcaaccgtgaatgaaggcataagttgccatcagaaaggaatcgaattcattggtacaacactgtctggctataccggtcccatcacgccggttgagccagatttggcaatggtgacacaactgagtcatgcaggttgtcgtgttattgccgaggggcgctataacacgcctgcactggcggccaatgctattgagcatggtgcctgggcagttaccgttggttccgctatcacccgtatcgagcatatctgtcagtggttcagtcacgcagtaaaacgctgaacaggaaaagaaaatgaacacgcttactattgatatttatgtctcagagaataatccgacgttaagaatgctatcggcaaatacgatacccaggcctgaagcctgtttgaacgcaatatcggatagctgctatttcaggtatccggcaggacatacgtctgggcatcaccattggtggagcataaatgctctgccttttacatctcatgattagcgtcattgagattaacaaaaactattgcttgatctgaatatcgtatcgtctgaatgatgggaagataaaaatacacagacgatgaccgcaacgctactcaaaaccataagcaggaaagaactatgattacacattctttcggcatcgttaattattttgtattatttggctacctcctggccatgatgttagtcggtgtctatttttccagacggcaaaaaacagcagacgattattttcgcggtggtggccgggttcctggttgggcggctggggtcagtgtatttgctactacgttaagctcaattacatttatgtcaattcctgccaaagcgtttacttccgactggacgtttatcattggtcagtatctggctatcgcaattttaccgctggttttttatttctatattccgttttttcggaaattgaaagtcacatcagcctatgaatatctcgaagcacggttcgatgtgcgctgccgtctgttcgccagcatgtcatttatgttgtttcatattggacgtatcgccattatcactttcctcaccgtgctggccttgcgccccttcatcgctatagacccggtgattttggtactgttgattagtgtgatgtgtatcatttatacctggatgggggggaattgaaggagtaatatggactgatgttattcaaggtctcttactttctggcagcgcgatactgatttttatagtgatatgtctcaaagtccagggcggcattggtgaaatttttacggtgacgcagcaggcggataaattctttccggctacgcagttccactggagctggacggaaagcacagtacctgtattgatgattggttttctgtttgccaatattcagcaatttactgccagtcaggatgtggtccaacgctatatcgtgactgactccatagaggaaacgaagaaaacattacttacaaatgccaaactggttgctgtgatccctgttttcttttttgctatcggctcggcattatttgtctactatcagcaacatccacaattattaccggcgggattcaacactggcggcattttgcccttattcgtggtcaccgaaatgccagtcggcattgcagggttgataatctccgctattttcgctgccgcgcagtccagcatctccagcagcttaaacagcatttccagttgttttaattccgatatctatcagcgtttgagtcataaaaaaggaacgccagaaaaccgtatgaaaatagctaagttagttattctggtcgcgggcctgataagtagcgcggcctcggtatggctggtcatggccgatgaatcagaaatctgggatgcatttaatagtctgataggtctgatgggagggccaatgaccggtctgttcatgctgggcattttctttaaacgagcaaatgccgggagtgcggttttaggaattattatcagcgtcattaccgtgctgggcacacgctatgccactgaccttaacttcttcttttatggggtcattggctcgctaagcgtggtgatcagcggcgttattttcgccccgttatttgccccggcaccgccattgacgctggatgaaaaacctgaaccaaaggtgacattatgatttcatgataccacgctataccgacacagcacacggtgacgccaacgcgcggggcgacaataccgggccagatataaaccatccgacagatggcgcgctataaacaccgtaagagcaaacagattactctccagtgatgttctgtcataagttggcaacgcgatgtaaatattccccctcctttacttacatcgcgctttttttcatgccgcagacttgataggctctgctctgttcgatattgcaggctttgtgccgcaatcagccctcaagagcaggaactatatggagcctcaacccccacgtcttaaacccggaaaaatccttgacactctgggtgctatgcaaaaaagcctgacacgtgcctcccagcgtattgcgcaatatattttagccttccccagacaggtgacacagtcatctattgccgatttgtcgcgcgacacacaggccggagaagccacggttattcgcttttgtcgcaccctgggctataaaggttttcaggattttaaaatggacctggccattgaacttgccactaccgagtctgatgacagtagtcctctactggatgccgaagttagcgaatccgacgatgcccacgccattggtttaaaattgcagaacaccattagtaatgtattatctgaaacgctaaatctgcttgatatgcaacaggttctcggtgtcgtggacgccctacgtcactgtcactcagtttatatctttggtgtgggctcatcggggatcacggcgctggatatgaaacacaagctaatgcgtattggtttacggggcgatgcggtaagcaataaccattttatgtacatgcaggctacgctattaaaagcaggcgatgtcgcgatgggtgtcagtcactcgggcacatcgccagaaacagtgcattcactccgattggcccgacaggctggcgccaccacagtcgccattacccataatctgggttctccattatgtgaagaggccgatttttgcctgatcaatggtaatcggcaaggaatgttgcagggtgactcgatcggtacgaaagccgcgcagcttttcgtctttgacctgctctatacccttcttgtacagtcctcgccggaacaggcccgagaaagcaaattacggacaatgaatgccctggacatgacaaaataattcccttcacgtacaggcgtcattttccttttttgtccatgagtctgctggacgctttatagacaacaaagcccggtctcccgggctctgaaagtcaatgctatattagctgtatgcgtggagcgttcgctgacaaagcgccgagcgcacgcagtcgtctttgttgaaatgcacaatccccaccatttcatcttcttcaaagcgttccaacgcatcactcaacccggaacgcacaccgcgcggcaggtcgcattgcgtaatatcgccattgacaatgaccgtgacattttcgcctaatcgcgtcaaaaacattttcatttgcgccgcagtcacattttgcgcctcgtcgaggatcacgaccgcattttcaaaagtacgcccacgcatataggcgaacggggcaatttctaccttaccgatttccgggcgcaaacaatattgcataaaggacgcgcccaaccgtttaagcaggacatcgtagacgggacgaaaataaggcgcgaatttttcagcgatatcaccgggcaaaaaaccaagatcttcatcagcctgcaataccggacgcgtcacaatgatcctctcgacgtccttatgaatcaatgcttctgccgcctttgccgcactgatccatgtttttccgcagccggcttcgccggtcgcaaaaataagctgtttactgtcgatagcgttcagataatgcgcctgtgcttcatttcgcgccttaacaggagaggtatcgcgactatcgcgcgccatgccaatggcttctactccgcccatctgtaccagtgacgtgaccgattcttcttcacgttgcttatgactacgcgaatctcgtctcaacacacgctttgcttcacgacgagctttgatcactgctttttgtcttcccatggatagcaccttgagttgtaggtatacatcacccgcgttctcttgaacgcgattatgcgcacacacatctgagggttggcttccttgtaagccttagcttgctttttgaaacgacgccacacacggctacgcgcaccacatatggcgtcatgggtatggacagtaagggaaatgatgagagcttttaagatgacaagaccaccaccggagagagaatgtccgtacagggtgttgtaactactgtaaacaatgtgtcctggtgcggacattaccattcgcgatctccatagtgagtgaccatcactgccggggaactaccgctattactactaagtacaacacaaaacatcaataatgcaacaatatattcaccaaacattaaccaaacattattgcgtcattgtcagtctcttacagaaagattacacaattatttcattggcaggagactaaaaaagataatcattagctactatgggtattaatggtgaaaacacccataacccattgaatattcaacatataaaagattaaaacggagtaattaacgtgtcctctctcccatcgctaaaacggcattatttatgcaaaattttgtgcggcatacttacgccagtaacgctgactcgttttaatttttgtcattactctattgcgtcaaggctattggtaccattaacaggcgatttcatatatggtcagttagtgattactcgagacgtattacggccgcgttaacggcgctcaagggctaaaaatagtttgagagagcgtcctcatttacctgaacaccttcagtcaatcggtccgggacttatcagaggaccaggcaggcgtataacgccgcctggtaaaatatatccgatggcaataatgctatcggacatgtcggttattccgcctgtagcttcgacggcggcgcggaatgataatgcgcgtccgcttttgcaaagcgttcctgcatcgttgctgtcggcgctttgccaagcaggctaaagattacgatccccaggctgccgaaaatgaagccagggataatctcatacagatccagccagccatattgtttccagacgataaccgtcaccgcgccaataatcattcccgccagcgcgccgttacgtgtcatacgcgaccacatcacagaaaacaggacaacaggtccaaatgccgcgccgaatccagcccaggcgtagctcaccagccccagcacacggttatcaggattcgccgccagcgcaatggcgatcagcgctaccaccagcaccatcactcgccctacccataccagctcttgctggctggcgcttttacgcagaaaagccttatataaatcttccgtaatcgcgctggagcataccagcaactgacagctcaacgtcgacatcaccgccgccaggatagcagacagcagaacaccggcaatccacgggttaaacaggatctgcgccagttcaataaatacgcgttctgagttttggttcaccgccccggccagcgcggggttattgttaaagtacgcaatgccaaagaagcccaccgccaccgcgcccgccagacacagaatcatccaggtcatactgatacgacgcgcatgaacaatactgtgatgggaatccgccgccataaagcgcgccaggatatgcggctgaccgaagtaacccagcccccagcccatcagagaaataatagcgacaaaattcagccccttgagcatgtcgacattctcgatgctcttttgcttgatcacttccagcgactcgctaaaaccgcctacgccgacaataaccatcaccggcgtcaggattaacgcaaaaatcatcaggctggcctgaacggtatccgtccagctaacggcaagaaacccgccgataaaggtataaataatggttgccgcggcccccgcccacagtgcggtttcatagctcataccgaaggtgctttcgaacagtcgtgccccagcgacaatacctgatgcgcaatagatagtgaaaaacagcagaatgaccagcgcggaaataatacgcaggactcggctcttatcctcaaaccgaccggtaaaatagtccggcagcgtgagcgcgttattgttaaattcggtatgcacgcgcaggcgcccggccaccagcttccagttaatccatgcgcctaacgtcaggccaatggcgatccagctttcagagatccccgacagaaagatagcgccaggcagccccattaacagccagccgctcatatccgacgcgccggctgataaagccgtaacaaacggccccaggctgcgaccgccaagaatatagtcatcaaagtttttggttgagcgccaggcgataaacccaatcaatatcatgccaaaaatatagacacagaatgtcaccaacatcggtgtgctaatagccatcaaggttctccaaatttatttattggcactaccgtagcgtgccgttttgtaccctgccggaacgtggcaagggtgttatgtttaccagggcgaccgtatcctgccggaatcggtggttattcacaatcgatttaacacaccatttacatcaaatttgattgcagagggatactatttttctccaggttgcactctctcacattttttgcggttgcaccttttaaaagtgttaactaccgcagagaaaataaatccagatggttttccccgtcagactcccactttctttttttaacaatttattcatttttaagcttgcaacgcaggtcacatttaacgcggttgcacaaagttgcaatatagtggatattttccgctaactattggttagcagatagagcgaataacaggagtagagggtatgggaaccaccacgatgggggttaagctggacgacgccacgcgcgaacggatcaaaatggccgcgtcgcgtatcgatcgcacgccgcactggttaataaaacaggcaatctttagctatctggacaagctggaaaatagcgatacgctaccggagctacctgcgctgtttgccggcgcggcaaatgaaagcgaggagccggtcgcgccgcaggatgagccgcatcagccctttctggagtttgccgaacagattcttccccaatccgtctctcgcgccgccatcaccgccgcctggcgccgcccggaaaccgatgcggtgtcaatgctaatggaacaggcgcgcctgtcgccgcctgtcgctgagcaggcgcataaactggcgtatcaactggcggagaaattgcgcaatcaaaaatccgccagcggtcgcgcgggtatggtgcaaggcctgttgcaggagttttccctctcttcgcaagaaggcgtagcgctgatgtgtctggcggaagcgctgctgcgtattcccgacaaagctacgcgcgatgcgttaattcgcgacaaaatcagtaatggcaactggcagtcgcatattggccgtagcccgtcgctgtttgtaaacgccgccacctgggggctgctctttaccggccgactggtctcaacgcataacgaagccaatctttcgcgctcgctgaaccgcattatcggcaagagcggcgaaccgttaatccgcaaaggcgtcgacatggcgatgcgtttaatgggcgagcagttcgtgactggcgaaaccattgctcaggcgctggcgaatgcccgaaaactggaagagaaagggttccgctattcttacgatatgctgggcgaagccgcgttaaccgccgccgatgcgcaggcctatatggtctcttaccagcaagcgattcatgccatcggcaaagcgtctaacggtcgcggtatttacgaagggccaggcatctcgattaagctgtccgccctgcatccacgctatagtcgcgcgcaatacgatcgggtaatggaggagctttatccgcgcctgaaatccctgacgctgctggcgcgccagtatgatatcggtctcaatatcgacgccgaagaggcggatcgtctggagatctcgcttgatctgctggaaaaactctgcttcgaacccgaactggcgggctggaacggcattggctttgtgattcaggcttaccagaaacgctgcccgctggtcattgattatttagtcgatctggcctcccgtagccgccgtcggctgatgattcgtctggtgaaaggcgcctactgggatagcgagatcaaacgcgcgcaaatggaagggctggagggctatccagtttatacccgcaaagtgtataccgatgtctcttatctggcctgcgcgaaaaaactgctcgccgtccctaatctgatctacccgcagttcgcgacccataacgctcacacactggcggcgatttatcatctggccgggcaaaattactatccgggtcagtacgaattccagtgcctgcacggcatgggagaaccgctgtatgaacaggtcaccggtaaagtgggggacggaaaacttaaccgtccctgccgtatttacgcgccggtgggaacacacgaaaccctgctggcctatctggtacgacgcctgctggaaaacggcgccaacacctcttttgtcaaccgcatcgccgatgccaccctaccgctcgatgaactggtggccgacccggtcgaggccgtggaaaaactggcgcagcaggaaggtcaggctggcataccgcatccaaaaattccgctgccgcgcgatctgtacggcgaaggtcggataaactccgccggacttgatttagcgaatgaacatcgcctcgcctcgctttcttctgccctgttaagcaacgccatgcagaaatggcaggccaaacctgtgctggaacaaccggtggccgacggtgagatgacgccggttatcaacccggcggaaccgaaagatattgttggctggggacgcgaagcgacagaaagcgaggttgaacaggcgttgcaaaacgcggtcaatcaggcgccggtttggtttgcgacgccgccgcaagaacgcgccgctattttgcagcgggcggcggtattgatggaagaccaaatgcagcagttgattggcctgttggtgcgtgaagcggggaaaacgttcagcaacgccattgccgaagtgcgcgaagcggtagacttcctccattattatgccggtcaagtgcgtgacgatttcgataacgaaacgcatcgcccgttagggccggtggtctgtatcagtccgtggaactttccgctggccattttcactggccaaatcgccgccgcgctggcggcaggtaacagcgttctggcgaaaccggcagagcagacatcgctgattgccgcccagggcattgccattttgctggaagcgggcgtaccgccgggcgtcgtgcaactgttgccgggacggggagaaaccgtcggcgcccagcttaccgccgatgcgcgtgtacgcggcgtgatgtttaccggttccacggaggtcgcgacgttgttgcagcgcaacatcgccacgcgtcttgacgcccaggggcgccctattccgttgattgcggaaaccggcggtatgaacgctatgattgtcgactcttccgcgctcaccgagcaggtggtcgtggatgtgctggcttccgccttcgacagcgccggacaacgctgttccgcgctccgcgtgctgtgtttgcaggacgatatcgccgaacatacgctgaaaatgttacgcggcgcgatggcggagtgtcggatggggaatccaggccgtctgacgaccgatatcgggccggtgatcgatagcgaggccaaagccaacattgaacgtcatatccagacgatgcgcgccaaaggccgcccggttttccaggccgcgcgtgaaaacagcgatgacgcgcaggaatggcagaccggtacgtttgttatgcccacgcttattgagctggaaaacttcgcagaactggaaaaagaggtcttcgggcccgtgctgcacgtcgtgcgttataaccgtaaccaactggcggagcttatcgaacagattaacgcttccggctacgggctaacgctgggcgtacatacccgtattgatgaaaccattgcgcaagtcaccggttccgcccatgtcggcaacctgtacgttaaccgtaatatggtgggcgcggtcgtcggcgtccagccgtttggcggcgaaggcctgtccggcaccgggccaaaagcgggagggccgctctatctctaccgcctgctggcacaccgcccgcccaatgcgctcaatacgacgctgactcgtcaggatgcgcgttacccggtggatgcgcagcttaaaaccacgccactcgcgccgttgaccgctctgacgcaatgggcggcggatcgcccggcgctacagacgctctgccgacaattcgccgatctggcgcaggccggcacgcagcgcctgctaccggggccgaccggcgagcgtaatacctggacgctgttgccgcgtgaacgggtgttatgcctggctgatgatgaacaggacgcgttgacgcagcttgccgccgttctcgccgtcggcagtcaggcgctatggtcagacgacgccttccaccgcgatctggcgaaacgtctccccgccgccgtcgcggcgcgtgtccagtttgcgaaagcggaaacgctgatggcgcagccgtttgacgcggtgattttccacggcgactccgacaagctgcgaaccgtgtgcgaagccgtcgccgcccgcgaaggcgcgatagtgtcggtacaggggttcgcccgcggcgaaagcaatatgctgctggaacggctctatattgaacgttcgctgagcgtaaacactgccgccgctggcggtaatgccagcctgatgacaattggctaatactgtggttaattaaggctccgtcaatggagcctttttactcgcgtcagaggaccgtatgaaacgaattttccttacctgcgcggcgttgttgttcagcagtcaggcgttggccgatgagtgtgccagcgccagtacgcagctggaaatgaatcgctgcgccgccgcgcaataccaggcggcagataaaaagctgaacgaaacctatcaaagcgcgattaagcgtgcgcaaccgccgcagcgtgagctattgcaaaaagcgcaggtggcatggattgccctgcgcgacgccgattgcgcgctgattcgctcaggtacggagggcggcagcgttcaacccatgatcgccagccagtgcctgaccgataaaacgaacgaacgcgaagcgtttttagcctcgctgctgcaatgtgaagagggtgatttgagctgcccactgccgccagccggttaacgcacgcgaatcccttcaataataatgcgctgaacgctttcgaccgtttggttgaaaaaggcttcatcgcgaagcgtcgcgccggttaccgcttcaacctgaggggcgaaatcggcgtaatgttgcgtggcggcccaaatcatgaagatcaaatgatgcggagaaacgggcgcgagtttcccgctgtgcacccatccggcaatcagcgcggatttttcatctatcaacgcttttagatcgccggtcagttcatccattaagagcggcgcgcccgccagcatctccatgcagaagagccgcgacgcctgcggataatcacgcgaaacctccagcttgagacggatatactctttgatggcctccagaggggaaaattctgcgcgaaacgccttgagcggcgccaaccagacatccagaatctgtcgcattaccgcgacatacagcgcctctttcgagggataataataaagcagattggttttggagacgcctgcccgctcggcgacctgttcaagacgcgcgccatgaatgccatactgggaaaaaacggcaagcgcggcggttaagataagctgccgttttgcaccggtggcctgcgaacgtttcccgatttttttctctgtgcgttgcgacatgcgccctctccttttcgtcaggacgcaagcataccaaatccggcttataaacaaaaaaaccgccggaaatccggcggcggtggcgcatgacgctttttagcgcgaaacgctcagcgtcttgctgttgtgacgcaggctagcgattacggttactgcttttgcccccttttttgcctgcttcggatgcacgctgcgggtcattcttaaaattgcccccgctgtgctgaccacttttacgacctgcttctgatgctctttcgcggtcttccgcaaaattaccggaaccgccacgatggtttgccattactgacctccgtcatagattagacatcatattgcataggtaatgaggagtatctcctcgcgccgcgtatgaacgatatcatcagtaacgccgcgtaaaattaagcatagtgaaaaacgccgtggtaggccgcttaccgaaatattctgcaacatcagaagccgaatatgcagaataataaccatgagaaataaataagttattcttatacttggaaaaatcaaagcgcttaaaaatgtatcattttgcaacaaaggtcgccaaattaattattgttataaatcaaagaaatggcgctgaaatttgcactcttcacaggagggcatatctttaaatagacgtagcgaatcgctacacacctgattaatctgaggagtagtacaaatggcaaagattctggtgctctattattccatgtacggacacattgaaaccatggcgcacgcggtggcggaaggggcaaagaaagtcgacggcgcagaggtcattataaagcgtgtgccagaaacaatgccgcctgaaatcttcgcaaaagctggcggtaaaacgcaaaacgcaccggttgccaccccacaggagctggcggattacgatgccattatttttggtacgccaacccggtttggcaatatgtcaggccagatgcgtaccttcctggaccaaaccggcggactgtgggcatccggcgcgctatacggcaagctcggcggcgtgttcagttctaccggaacgggcggcggccaggagcagaccatcacctcgacctggactacgcttgcccatcatgggatggtgattgtcccgataggctattccgcacaggaactgtttgacgtctcccaggttcgcggcggtacgccttacggcgcaacgactatcgctggaggcgacggttcacgtcaaccaagccaggaggaactctctatcgctcgctatcagggggaatacgtcgccggtctggcagtcaaactcaacggctaatcttcaacaggaggattcgaatgccaactcaagaagcaaaagcgcaccgcgtcggcgaatgggcaagcctgcgtaatacgtcgccggaaattgccgaagccatttttgaagtcgctcactatgacgagaaactggcagaaaaaatatgggaagaaggtagcgatgaggtgctgatcaaagcctttgagaaaacggacaaagactcgctcttctggggcgaacaagtcatcgaacgtaagaacgtataacacaaacgcccccgcctgcgcgggggcatacggctattttgcagcagtgttcatgacgttatcgaacttatccagcggacagaagccgttcgcatccaccggacatcctttcagttccagcgttaccctttgcgcaggcgatttgagcgttaacgcttccgcattacgtaactgccgggcgctctggtagacatactcgattttcatcaaatcccggttagcgttaccgtcatgccagcgttggaagacaagctgaccaccaatcggcgttctctcatactggtcatggagctgatagggtttaaaatccagcgccgtcagcagcgacgcgatattggaatcatgccccaccagcacggtaaccttcggcgcgctaacgcgctcggcaaccagcaccttatcgatatattttaccagcggcgcagcgacattgcgcgccaccgtgggtgaggtaaacaggctgtcctggtagccgtttttcagttttgacagcaccttccactgccgatcggtgtggatcccgccccaagcgacctgatccatcggaaagccttcgtaatattgcagggtaaacgcatccaccagcgagttccctactttcagcggcccctgcacgccaggctcttgctgatagttcgcgctgaaggtatctttcgcgtcgattagcgaacactgatgcttctctttgcaggacggcgagtcctgataatgcgttatctgctcaagcagtttataactctcatcaagatgtagctgactacgcgccttttccatcgcctgtacggcctgttgccggaacgcggcggaatcatcggtaatcaccggattgaaggtagggtccatagtgcccattttttcctgatgatgaacaggaatatcacagccggggaaagcgctggtaatgaaaaattgcgcggtggcgacggtgcgctgcaaactattcgcataggcatataccgtgtcgggcgccggacattctcccgacggtatcagcccctgcgcgaccagccattcacgtgtgtagtgtcccatatagacttccagcacgccgcctttcgtcgtcagttgcccgccgggaacgtcccacgccggccaggcgttcggcgtcgactgcgccagtacgttgccattattcgccagcggcgcccgcagattatggcggctcatcatcagcacctgttgtaattgataaccttccggcgttgtctgcgcctgtacggcggatgacaacaaaacagcccctgccacagcaacagcgagtaatgattttttcatccctatgacctcttgttgttatcaaatcgttctgagtgtgacagaaatggatcatttttccgggaacgatttcgcaaaacggaggtttttcttacagtaaacgcgttagcgccgggaaaccccggcgcatattcagaacgtttttgcccaccacagccgaagcttcatgccccaatagctggtccagccgctggtggtgaacacaacccgaccttgtgaaaccaccaccagcgttggcgtcacgctgatttcccagccagcggataaggcgccgttagcatcattgacgaccgggaagtcaacgcccttgcgcgccagccagcgggcaacctcagcatcaccgccggagcggagcgcaacggtcatgacgttttccccttccgccgccaggtgagcgaccgcaggcgtggtaaagcggcataccccgcaccagctggcccaaaaatagagcagtacggggcgttcctcgctcaaggtcgccagagttgtcgactctcccgtcagcgtatgtaatggtgtcgcggcaaacgccggaggcgcctgcggcgcgcgccagacgtccatgaccaccattatcgcgatgaggagcgccagaaaaaccgcggcttcacgcagccaacgccgcagtttacccgccattggcagccgccagtttttctttcaccaccgcttccagcgtatcccagggcactgcgcccggaatcagctcgtcgccaatgatcgtcgctggcgttccttgcacgtcgaccagtcttgccaactgcaaattagtgcgtatcgtttccatgcttttttcatccagcgtcactggcgtcgcccctgctttctgctgggcctgtttaatactgtcatccgtatggtaaccgcgcttttgcataagtttttcatgtagcgcgaggaactgttgcggatgatcgcgccaggtggtcagcgcaatacgcgccgccagtatggaactctctcctttgaatggcagcggtttaataatgaccgcaacgtcaggatatttctgcacaatcttttccagcatcggatcgagctgtttgcagtacgggcagttgtaatccgtaaagttcaccagcgtcagcttagggtgtttagcgcctatccgcgggctggcaggatcgttaaacaacgccgcatggatcagatttttaatctgcttttcctgatccggcgtaaaaggagcggtttcttgcgcgatgctcagcgtcgaaaacagcgccagcagtaaaacaatcatgtatttcattgggttattcctttcgcttttttcaacgtttgtaataccgcatcgcgggtcagcaaagtgggcagtgcctccccttccggcaaaccggggccatatacctgattaaacggcacggcgacctggccgcgcgttttcagaaaatctgtaatggcatcggacggcagcgtccagtctccccgcagcgccacaacatccggctgttgcaaggcggcctgcacatcctctttttgcaggacgttgtatttattcactttacaggtaatacaccagtccgcagtgacatcgacaaatacccgcttatgctgcgccagcgccgactggattgcctgttcactcaacggttgccactgaaccgtgtcttgcgcgctctttgacgcagtgaagccgaaatgcggcaggagtaacgtcgccagccagatagccgaccccagcatcatcagaccgaggatcctgcgcaggacattcatccaacgcccggggcgcggtaaacgtagcgcaagccctggtcgtatcgcgaccagtagccacggcgcgctcattcccaggccaagcgcaaggaacagcccccacagcgtcggcagcgacgccgtgagcgccaccgcgaccgccgtgcccagaaacggcgcgctacaaggcgtcgccagcagcgtggcgaacgccccctgccagaaatgtcccgacataccgttaccgccgtaagtggccagtttcgtggtcatagatgagggaagcctgaactcaaaaagcccgaacaggctggcgctaaacaacaacatcaccagcgccataaaaccaataaaccatgcattctggaactggactccccaggccagcgcatggtttgacaggcgaaggagggtcataaacgccgccagcgccataaatgacgcaatgataccggcgaccgaagccaaaaattgtcgcctgatgtgagagcggcttttttcctctaccaataaaatagagccaagtttcatgcccagaacaggcagtacgcagggcattaaattaagaatcagtccgccgattagcgccatcattacaacttgccagaaaggtagcgccgcattgtccggcgtttgcgctggcgcagcgccaatggtttgcgtgctctcctgggcgatagcgccatcggctaacacgagggtcagcgatttgtcgcgcaaatcgggcgccttttcgccccaactgtccgtcaccggcaccgtcgcctgtaacctgtcgccctctacgcgcaggcgaggcttcgcaaaatcgacgtcatctatggtgtcaagatagagcccgggcgatgaccagcccgccgctcgcgtagcagtgaccaccagttctcccgggcgatagccaacgtcaagcgagtccgttagcccactgcggagcggaactttacccatcgcccgcgcatagtcatgggcaaaatcggcattctgcacagtgggcgtcacggaaaaggggtaatcggtcaacagacaaacattgctgcaggttgataacgtcaacacaccgcgcaaggtcgccggcggcgtaccgcgcacgatcatcggaaaggtcacctcgtcgtgatatccctgggtggtgatattcgccacatcaaagcgcgagggggttggccagaaccagcttacctcaggcatgtcgcctttccaggcgatagagggtgccacgcccccttcccccggcgcgcgccagtaggttttccagccgttttccagtttgacatccagcaacagccgggtctcactgttagcggacgtatcggcacgtagccgtatgctggcatggtcgttatcgggcgaacgcagccagccgctttccgccgcccaggagacgggcagccaaagccataacaggcagaacagtatccgcctgaataaaatcatcatattttttctccgtgaatgagtaattaaccgttagtaataaccggtctgtcattcacggaagacacaaaatcgtagatgtacccgtaatgtgggcggcgaaatagcccgtggaggcgaaaacggcaggcgcatgacccggacaggcgccagtaaggaaagcagtagataacgcgcaaggatagcaccttcaaagagtactggaggcgccgccagcagcgacttggcgcttaattcgcagggagtgaccggcgagccgtcatctgtcgaggagggagcgctgaccaccgcagcagaggccgtcgcctgcatctgcaaggcgtgcaggcccgccatgcgttgcgcggtacaaaccattaccacgacacatgcaaggcaaagaaaccaccagcccatccgttgttgtttcgccattgcgccctcactgtttaacgcgagttatcttagccactggcgcggttttggcaacctttcccctgtaaagttatgtcggcgcgctgcgcaaccttctgatagtcgaacaacgtaatttattcttactaatgatataactggtgttttcatacgcacttttcaggtttaccctacacttagtggagaaacctttttggggtcccttctgtatgtattgatttagcgagatgatgctatggaacttaaggattattacgccattatgggcgtgaaaccgacggacgatctcaagacgattaagaccgcctatcgccgactggcccgcaagtaccatccagatgtcagcaaagaacccgatgccgaagcccgtttcaaagaggttgctgaagcatgggaagtgctgagtgatgagcaacggcgcgccgagtatgaccagttatggcaacaccgtaacgatccacaatttaatcgccagttccagcaacacgaaggccagccgtataacgccgaagattttgatgatattttctcgtctatttttggtcagcacggtcgtcattcgcaccaccgccacgccgcacgcggtcatgatatcgaaattgaagtggcggtattcctggaagaaacgctggaagagcaccagcgtacgattagctattccgtccccgtttataacgcgttcggcctggtggagcgggaaattcccaaaacattgaatgtgaaaatcccggctggcgtcagcaacgggcaacgaatcagactgaaaggccagggcacgccgggggaaaacggcggacctaatggcgatttatggctcgttatccatattgccccgcatccgctctttgatatcgtcaatcaggatctggaagtcgtccttccgcttgccccatgggaggcggcgctcggcgctaaggtgtctatgccaacgcttaaagagcgtattttgctgaccattccccccggcagccaggcaggtcagcggctgcgtatcaaaggaaaaggattagccagtaaaaagcacactggcgatctctatgccatcatcaaaatcgttatgccgccgaaacctgacgagaaaacagctgccctgtggcaacaactggcggacgcgcagtcgtcctttgacccacgccagcaatgggggaaagcataatggctaacatcactgtcacctttaccatcaccgaattttgtttgcacaccggcgtgacggaagaggagctaaacgaaatcgtcggacttggcgtaattgagccttacgaagacgataacgccgactggcaattcgacgatcgcgcagcgagcgtggtacaacgcgcgctacgcttacgcgaggagctggcgctcgactggccagggatcgcggtcgcgttaacgctgctggaagagaattcacggctgcgcgaagaaaaccggttactgctgcaacgcctttctcgctttatctcgcatccctaatccacgataaaggcaataaaccgagggtgggctttctgcccaccccggatttacatacacccggtataataccagaatgcctctgacatacttcccgcaacggaagaaatatagcctttcaccgcgcacaagccgatcaacgaaccgccaatgtcagccattaatgcgccattgcgaagatcatcgtttaaataaagaccagccacacgctcacattttttagattcgtcggttatttttacacgttagcgatcatttattgcctgaagaatatattctttcactgttttgtactctctggttgatacgtatcttctccctgtcaatgccgggtaaaatgtaccgctgcgcttacaggttgcggtatttataaataagaaatacaacagtcacttacagtttaataattgagcgttataacatccactaccgcccaatatttacaccacgtataaaatacaaaaatgtaatagaatgtaaacaaaataagagcataaaataaataacttattaaaaaatcaatataaatagagtggtcaataaaaaacgatcgttttcaacgagttatgtttctcagattttcatctatcctgaataggcttgcggaaaatgtaatttacaccattgactatttcacttaaaaggtttctgtaatggaatggaaggtcgttgatacagttataagtccctctaccggagtgtcgttctcatgcatacatagcctaaaaaatcttagattgaccttatggtatcaagcagatgtttacatgcctccaggtagcattatcatcccctttaataagggggtcttaataaacgataaactttatcccgttactgtttacaacgttaccaggtttaatcctgttctatggaaatcgcttaaagaaaatagccactgtcctggtaactgcaatcctaaaccagaagcttgcagttatcctttcgagtgtctggtatccgtttgtccatttggtttaaccagaaatattcaaatagataataagaaagtttaggaaataaagtatgcattagccatactactgattaagtgtattcgcgcacgtttgcagtattttgcagttaaatatgtttgatataaaaattgtacagttcggatattttttgattcgtttaatctaaccttcactttggcaacgaggagccggtacagaggatattactgatggccggcagacaaagaaacgcattgcttttaacactgtataaattccatccgtgacattcttatttagtgatatttcaccagagcaatcatcttacctttattgtgcataaaaatcagcaagtagtgtttagaaaaaataatgttttagacaaaagctctgcgcgtcatgctgatcgccaaaagcataacgggctgacatgatgtcagcccgttggtttacccctgccctgatgcttacggtacgcttatcgtcatattgtcatgaccgacaatgacagggcccgggtaatttttcatggcttcctgttgccagacgtcatccgcaaccgtcgcaggcaccagatgacttaacaccagttttttcacgtgggcctcgcgagcaatcttaccgacatcttcaatcgtggtgtgatgcgacgcaatcgcttcagccagcgtttttccgttgccaatactattagccagttttgctaccgaagggacatgtaccgcctcatgtaccaggatatccgccccctgggcaaacgttgcaagcggaggaaaccaggacgtatcgccagagaagacgattcgcttaccctgagtatcaaaacggtaagcaaacgcttcaccgtccgggaaaggggaatgaggcactttcagcgcgcttattgtgaccagttcatctttatagatgacgccctggccgatatcggtcgccttaaccaggttgcgcggatcgggtttcccctcttcttccatgcgtaacgtgatatccctgtcaaagaccttccagctagccttcgtcatcgcctgggttcccggcgggccataaacctgtatggtatggtctttcaggccacttgcccaggcattcatcagcaaggaaggataatccagtatgtggtcgctgtgcagatgggtgagcaaaatagtattgatgttgcgcagtggaatgccatttttcaccagttgcagactggcgccgtagccggcatctatcagccatatcttatcgccgatagtgagcgccgtcgcttgcggtagtctggctgtattgagcaaagaaggcccgcctttggtgcccagtaaaacaatgttgatctcttgaggcgcaggagcaccggcagcaatggcaaggtggctttgcgccagcatacaaaccgccagcatagcgacgctttttttcatcatgtttttactcttcttagttgagaaaagaaggaacttcacgttggcgaaactgcgaaggagaacagccagcaaggcgattaaagaaacgggcgaaataagccggatctttaaaacctaattgccaggcgatctcgttgacagcattgtcggaaaaaagcagcagtcgtttcgcctcgcgtaattgccgatcaaaaatcaggcgtttaggcgggcgattagcaaaacgtcggcaaatatcggtcaaacgagattcggtaatatgcaactcacaggcataatcgggcaccgtccagtgctgatggaagtggttgtcaattaacagggtaaagcgctgaaaaagtttcagttcaccgcgcatcccggttgcggcatgatcgtccagcttcgcattacgcaacagcaaggtaaataccgcctgcgccagtagtaccaaggtatgttcgcagccagccagttgttccgtggactcccgctcaattagctgccagtaatgtttgagcgccgccagctcgttgagtttatccgccagcgacaggcagattcccggcaggccgaaggcctctctggtgccgggataaagcacttccagcagcggccaaaccagctcttcgcgtaccgtcagaacatgaccatcgctatccgattcggtaataaaagcatgcggcaccgagggcggcgttagcacaaatagcggcgcctgcaccgaatagcgatgatcgtcgagctgtagctcaatctgcccggtatcaagaaagtgcatttgaaaaaactggtcgtggcgatgcgcctgcatatcacgaccaaagaaatccgccatacgagcaaacgactgataatgcacatcgttactgcccatgctttcgtcatactctttgctgatatcaatattggcgatcgcacgttggcacatagtttctcctcaaggggtggcgcgcggacgcgatgctttcatgggaatgagccagataatggcggcgccgacgactaacagagaagcgacaaaccagagtccgctattgaagctaccagtgatatcttttagccagccaatcataaccgggctgagcgcggagccaatattgccggtggcattgatgaccgcaatgcctatcgccctggcgcgtaaactgatcgactgatccggcgtggtccagaagatcgccatcgcgctaaaggaacccgtggatgccatcacgatccccaggagctggatcaggttacggtcggtcgccgacgccagcagccagcccgcggcggcaaacaggaacggtaacgcagtgtggtgtttacgctcctgatgtttgtccgaatggcggctccagtaaatcatgcccagaacagtacaaatctgcgggatcgccgccagcaggccgatggtgatattgctgctgccttcattaaaacttttcaggatttgcggcgtccagatactaatggcgctaagcgtattggtaaggcaaaaataggccagcgtatacatcagtacaattggcgtgaatacttcgcgccacaggctacgctgctgcatggcgttatggctgatggccccctcaggctgaaccagcgtcaggcgatcattatccatcatctcctgcaaacattttttatcctctgccgtcagccatttggcttttgccggggtatcatccaggtaaaaccagaccataatgcctaacaaaactgacggaaatccttccaacaggaataaccactgccatccatgcagattgaatatgccgtccagcgataaaatatagccggagacaattgaccccaacgcggtagtggccggcatggcaatcataaataatgcgttggcgcgggcgcggaaaaatgccgggaaccagtaggttaaatagagcaatattcctggcaaaaagcccgcttcggtaatgcccaccagcattcgcagcacatacaggcttttcggtcccaccgcgaacatcgtggcggtagatgcaatgccccatagcaccataatggtcgcaatccagcggcgggcgccgacgatgctcaacatcacgttgctgggaatgccgaaaatgacgtaggtggcgtaaaacagcgtcgtggcaagaccaaacatggtggcgcttaaccccagatcctgccccatcgtcaacccggcaaaaccgatgttgatacggtctaaaaacgagaagataaacaacacgaataaaaatacgatcagtcggcggaacagtttatttatgacggtttgttgacccgtgctgagcgcgttgtgcgaaccgacagactcggggctttccggaagtgcagatgatgtgtcgctcattttttttcctctgatgggaattttgtagggtactacggttgcccggtagcgctgcgcttaccggcccaggcttaatagacgccggacgcaccggacagttttttttctgcgccaaagcgcgccgccagcgcctccgctccgcgcgccagcagcgtggtgtcaacgccgacggcgacaaatagcgcccccagttccagataacgtttcgccagtgcttcattggccatcagaatccccggcgctttccccgccgcgcgtatctgcacgatggcgttctcaatcgccgcctgcacttccgggtgctgcggattgccggcaaagcccatatcggcgctgagatccgccgggccaataaacacgccgtcaatgccatccacgtcgagaattgacgccagattgctcatcgcctcacgcgtttcaatctgcaccagtacgcacatggcgtcgttggcctggtggagatagtccggaatgcgattccagcgcgatgcccgcgccagcgcgctgcccacgccgcgaataccggcaggcggataacgcgtagccgccacggcgtttcgcgcttcatcggcattctgcaccatcggtatcagcagcgtttgcgcgccgacgtcgagcagttgcttaatctgtaccggatcgttccatgacggacgcaccaccggctggctgggataaggcgcaatcgcctgcaactgggtcaacaccgtctgcacgttgtttggcgcgtgttcaccgtcaatcagtagccagtcgaagccggcgcccgctaacagttcagcgctgtaactgttggcaagccccagccacaaaccgatttgcgggcgccccgcttttaacgcgtctttgaaagcatttttcatcgttttttccttacacaaaccggcaactgatcgcgcccatgttgccgtaatcgacatggaaggtgtcgcccttgcgcgccggcaccgggcgggtgaacgagccgccgaggatgatctgcccggcttcaagctggacatcgtagggggcaagcttgttcgccagccacgccacgccgttggccggatgattcagcacgcctgcggcgacgccggtttcttcgatcacgccgttgcgatagagcagcgcggagatccagcgcagatccagctcgtctggtttgatggggcgaccaccgaggatcaccccggcgttggcggcgttgtcggaaatggtgtcgaacactttgcgcgggcgctgggtttccgggtcgatgttgtggctgcgggcgtcaatcagttccagcgccggaatcacataatccgtggcgttgtagacgtcgaacagcgtgcagtgagggccgcgcagcggtttcgccagcacgaacgccagctccacttcaatacgcgggacgataaaacggtcggtggggatatctccgccgtcatggaagaacatatcgtcaagcagcgcgccgtaatccggttcgctgatttgcgagctggcctgcatcgcttttgaggtcaggccgattttgtggcctttgagcgtgcgcccttcggcaatcttgatattgacccattcacgctgtacggcataggcatcttcaatagtgatgttgggataatccagcgacactgcgcgaatctgttcacgctgtttttcagcctgattaagtcgctgagcgatcagggtatgggtctgtttatcgagcatagttgcttcctgttacctcattcggtgctgctgcgccgggtggcgacgcgggtgcgtcttacccggcctacggttcggtactgcttcgtgcatcgtttttttgtaggcccggtcagcgcagcgccaccgggcgaaagagtgtgctatttaaataacgcgtgtacgttgttttgtttgtaattgagcgttggatgtaactcggcaatctcaaacgacagcgccagatagcggttctccatcaggtcggcgaagtgggctttaatcagcccaaacagcatttcgccgacttcctgacggctctccaggctgcgcccggcgccgattttcagcgtcatatgcacaaacgcgtaatcatgcttaccgtcagccatctgccaggtatccagccagtgggcgcgactgcggataccgccgatggggaaaatcccggtggcggccagcgcctcgtttaccttgctgaacaggcttggtaaatcagcctgctcgcgaatattttcagtacattcagcaataaagtgcggcataaaccccccttacgcaggcagcgggaaaacagcgtttacctggccggtaccggagctggcgaacaggtcggtgatgaactccaccttgccgtcgtatttgtcccaccccagcattcccagtagcatgaccgtgtcgtgcatgttgccttcgccgtagcagtagtcggcgtactccggcaacatggtgcaaaactccttgaatttgccttcgcgccacagcttgaccacgcgctcgtccatttgatgatcgaactcgcgggtgtagctgttcatcccctcttccgcccgttggtcgtcaataaaacggtgcgacagagaaccactggcgaataccgctacggtaccgtcatatttctcaatcgccttgagaatggcttcgcccagtttgcggctgtcggcaaaatcatgcacagtgcagaacgccgagatggagaccactttgaagtgcttgtcgctgttcatgtagcgcatcggcaccagcgtgccatactccagcttcaggctcgggatgttgtgcgctttggcgcgcacgcccagtttgaccgcctcgtcggcgatcagatggccgagcgccggattaccgtcatagtcataggtcatgtcgcgaataaagtgcggcaattcgttgctggtatagacgccctggaaatggtcggcacaattaatgtggtaagcgctattcaccagccagtgggtgtcgaatacgataatggtgtcaacgcccatttcgcggcaacgcttgccaatttcaatatgcccatcaatggctgcctgacgacaaccgtgattttttcctggcagttcagaaagatacatcgacggcacgtgggtaatttttgctgctaacgctaacttgcccatatcaaactccccattttgggataggatggtcgcccattgagatgcagacgtttttcatttccgcaaacacttcgaagctatattcgccgccttcgcgcccggtaccggaggctttcacgccgccgaacggctggcgcaggtcgcggacgttctgggtgttgacgaagaccatgccggcttcaatcccacgcgccaggcgcaacactttgctcacgtcctgggtccagatataagaggccagaccgtattccacatcgttcgccaaacgtaacccttccgcttcgtctttgaatggcagcaggcaggcgaccggcccaaagatctcttcctgcgcaacgcgcatacggttgtcgacatcggccagcacggttgggcgcaggaagttaccgcctttcagatgcgcaggcaggtcagtgggtttttccgcaccgcccgccagcagcgttgccccctcttcaatgccgaggcggatataaccggagactttctcccagtgctgttggctaatcagcgcgccgacctgggtgttcgggtcggtcggatcgccgacacgcaggcgattcgcgcgttcggcaaagcgcttcacgaactcagggtaaatgctctgctggataaagatgcgcgacccagcggtgcagcgttcgccgttgatcgagaagatggtgaacagcgcggcgtccagcgcgcgctcaatgtcggcgtcttcaaaaatcagcaccggcgatttgccgcccagctccatcgagtattttttcagcccggcatttttcatgatattgcgaccggtggcggtaccgccggtaaacgacaccgcacgcacgtcatggtggcgtaccagcgcatcgcccgccgtcgcgccgtagccctgcaccacgttcagcacgcctgccggaattcctgcctccagtgccagctcgcccagcctgtcggcagtcagcggcgacagctcggacattttgagcaccgcggtgttacccagcgccaggcacggcgcaactttccaagtcgcggtcataaacggcacgttccacggcgacaccagcgcgcagacgccgacgggctgcaccagcgtataattgagcattttatcgtcaaccggataggtcttgccgttcatctgctggcacacttcggcgaagaattcgaagttatgcgaggcgcgcgggatcagcacgttttagtctggtgaataggcaggccggtgtcggcggtttccatcgccgcgatttccggcacatgctggtcaatcaggtcgccaaggcggcgcatcaggcgcgcgcgctctttcatcggcaggttggcccatttcgggaacgcctcttttgccgccgcgacagcctggttcacttctgcttcaccgccggaggctacttccgccagcacatcaccggtcgccgggttagtggtctggaagtagtcgttacctgcaacgtttttgccgttaatccaatgatttattttcttcattttgcgctctcctcactgacgattcggttaaccaggcgacccacgccttctacttcaacgacaacttcatcccccggcaccacatcggacagccctttcggcgtaccggtggcaatcatgtcgcccggttgcaacgtcataaattcgctcagataagaaatcaggaacgggatgctgaagatcagatcggcggtcgtcccttcctgccgcagctcaccgttgacaaaggtgcgtaacgtcaggttgtgcggatcagaaaccgcctctttatccacaatccacgggcctatcggcgtcaggccgtcgcggctttttacccgcagattcggacggtagtagttttccagatagtcgcggatcgcgtagtcgttacagacggtgtaaccggccacatactccatggcttcggcttcgctcaccttacgcgccgttttgccaatcaccacgaccagctcggcttcgtagtgcatatattcgacgttgttcgggcgcaccgacgtttggtgatgttcggtaaaggtgtttggcgctttgataaataccagcggctctttcggcggcgtaaatgccagctcgctggcgtgatcggcgtagttcaaccccagcgcaaataacgttcccgtcgctgacagcggccacgtaaacgtctggtggcgggcgaattcatcttctgcgacaaccggattttccagcgcgggtaaacctttcgccagaatacgcacccgatcgccgggacgcagcgcaacgcgattctgcggcgtaccaagtaagatcgcatcgccagggttaagtgtagcgaactcacttaacgcgctaagcagttgtgcggcgctacgctgtaaatcggcagtattccagtggtccgcttctcgtccgttgatttcagtgataatggtgagattatccacatcactcagcggcgccatttcacccagcgggcaaaagccatcgcgacatttcgctttaatcgccgggcgataaaagctctcttccggcaggctgacctcgttagccagcgcatacccggcgatatagtccgccgccgcttcagggcgtatccggctggcggttttccccacaatgagcgccactgtcgcgccgctcagtaccttttctccctgcggataaggaatgggttcgccgtgacgaatcaccgtattacgcggcttgatgaaccacactgcggttttaggcggcgcattatagggaggctgagagaaagcctcttgccaggcatcaagctggctgcgatggtttaacgcaacggcgaaaacagtacccttcatacataaactcctcaggccgatttaacgggctgtgatttcattaacatattaatgattagatttatgctttcgctgtacatttagcaagcttaagtaaagtatttatgatgtgattaacaatattttcacaaatttattattaaatacatatatatcaaatagttaaataaaaccccttgtttctattaaactttggacataaaacagatgtcatagctcacatcggtaaacacgattattcaggtattaataattctgcaaaagagaaacgcttatgcatgattcattaaccatcgccttgcttcaggcgcgcgaagcggcaatgacctatttccgccccatcgttaaaagccacaatctgaccgaccagcaatggcgcattgtgcgaatcctggccgatagcccctctatggattttcacgagctggcctttcgtacctgtattttgcgtccaagtctgaccggaatattgacgcgcatggagcgagacggactggtgttgcgactcaagccggttaacgatcagcgtaagttatatgtcatgttgacggagcagggacaaacgttgtacgcccgtgcccggagcgaggtagaagaggcttatcgaaaaattgaggccgatttcacgcccgaaaaaacacagcaattgatgctgctgctggacgatcttattgctctggggcgccagcatcctgatagcgaagcggaagcatagtattcttaccttcccacgccgccgacacgggaatcccctcccgcttacaccctgtgctggaataccgataccggcagcggcggttatacgcataaatttttccgcgtggcgaaaagcgcagacgatctgcgccaacagcgtgatgctatcgccgagtggtcacgcctgagttacggctggatgggacgcacaccggattacaaagccgcctttggctgcgctctgggcgctaacccagccttctacggccagtttgagcagaacgcccgtaactggtacacccgtattcaggagaccggcctgtactttaaccatgcaatcgtcaacccgcccattgaccgccacaaacctgccgacgaagtgaaagacgtctatatcaagctggagaaagagacggacgccgggattattgtcagcggggcgaaagttgtcgccactaactccgccctgactcactacaacatgattggtttcggctcagcccaggtgatgggcgaaaacccggattttgctctgatgtttgtcgcgccaatggatgccgaaggcgtaaaacttatttcgcgcgcctcgtatgaaatggtcgcgggcgcgacgggctcgccgtttgattatcccctctccagccgttttgatgaaaacgatgccattctggtgatggacaaggtgctgatcccgtgggaaaacgtattaatttaccgtgatttcgatcgttgtcgtcgctggacgatggaaggcggctttgcccgtatgtatccactgcaagcctgtgttcgtctggcggtaaaacttgatttcattaccgcgctgctgaaaaaatcgctcgaatgtacgggtaccgtagagttccggggcgtgcaggccgatctcggcgaagtcgtggcctggcgcaatatgttctgggcattgagcgattctatgtgttctgaagcaaccccgtgggtaaacggcgcctggctaccggaccacgccgcgctgcaaacctatcgtgtgatggccccaatggcctacgcgaaaattaaaaatattattgaacgtaacgttaccagcggcctgatttacctgccttccagcgcccgcgatctgaataatccgcaaatcgaccagtacctggcgaaatacgtacgcggctctaacggaatggaccatgttgaacgtatcaaaattcttaaattgatgtgggatgccatcggcagcgagtttggcggtcgccatgagctgtacgagattaactactcgggcagccaggatgaaattcgtctgcagtgtctgcgtcaggcccagagctccggcaatatggataagatgatggcaatggtcgatcgctgcctctccgaatacgatcagaatggctggacggtttcgcatttgcacaataacgacgacatcaatcaactggataagctgctgaaataacgcggcaggaggttctcatgcaagtagatgaacaacgtctgcgttttcgcgatgcgatggcaagtctggcggcagcggtcaacatcgtaaccacggcgggtcacgccggacgctgcggtatcaccgcaacagcggtttgctcagtcactgatacgccgccctccgtgatggtatgtattaatgccaatagcgccatgaaccccgtttttcagggcaacggcaggctgtgcattaatgtacttaaccatgagcaggagctgatggcgcgccactttgccggtatgacggggatggcgatggaggagcgttttcaccagccatgttggcaaaacgggccgctgggccagccggtacttaacggcgcgctggccagtcttgaaggcgagatcagcgaggtacaaaccattggcacgcatctggtgtatctggtggcgatcaaaaatattattcttagccaggaggggcatggcctgatttatttcaaacgccgttttcatccggtcagacttgagatggaagcgcctgtttaaccgtcactcatacccacaagcgggataaccaccgcttgtgggaggagagtcgatacgctgaagatttttattcccgccgcgatgtttgctcgccataaatcccggcgattaataaaatctaagagcctatcccaccaggcgttattggcgcagcctgtttggacacggacagcgcgcaaaaaccggagcgtacacgttgtatgtgaggtttgactcgctacgctcgcccttcgggccgccgcaagcggcgttcaaaacgctaacgcgttttggcgagcactgcccaggaccaaaatggcaagtaaaatagccctaataggataggctctaaattagctcccgcgataggttgaataaccatactgacttaataacagcggcacatgatagtgctcattcgttttgctgatatgaaactcgacgggaatctccgggaaaaacgtgtccagttttttactttcaaaatactggccggttttaaaaataacgcgataatcccccggcgcggcagctttttcgggccacagtgctttaattcgtccatcctggtcggtatgcccggtgtttaattgcgtccatccgttatcctttttctgctccagtaccacctccacgccgggcgctggtttgcctgtttgctgatcgagaatatgtacgctgagaatattgctgccagcggccagcgccattgccggggctgcaacaagagacgctatcgcggtagccagtatatatcgtttcatgcttcactcctttacggtattgatgcaggaaaatatatctggcgcgtccaggattaaccttacacggacatgacaattatgtcatcttgttggagatttacggattcgctaacaagcctatggcatactgcgttgatgaagattttattgattgaagataaccagaaaaccattgagtgggtacgtcagggactcacggaggcaggctatgtggttgattatgcctgtgatggacgagacggattacacctagcccttcaggaacattattcattgattattcttgatattatgctgccggggcttgatggatggcaggttttacgcgcgttgcgcactgcatatcagccccctgttatttgcctgacggcgcgcgactcggttgaggatcgcgtcaaaggtcttgaggcgggcgctaatgattaccttgttaagcctttttccttcgccgaactgctggcccgggtgagagctcaactcagacagcatgtcccggtctttacccgactgacgatcaatggtctggacatggatgccacaaagcaatcggtgttacgaaatggcaaaccgatttccctgacccgcaaagaattcctgctcctctggttactggcgtcccgggcaggggaaatcgtgccccgaaccgcgatcgccagcgaagtttggggaattaactttgatagtgaaaccaacaccgttgatgtcgcgattcgtcggctgcgcgccaaagtagacgatccatttgaaaagaagctcattatgaccgtccaggggatgggttatcgattacaggcggaaacgtcgcagaatggttaagttatcaatgacgctgcgcctgacaatttcttttatcgccatacttatcctcgcctgtaccggcattagctggacgctctataacgcgctgagcaaagaattaacgtatcgggatgatatgacgctaataaatcgggcggcgcaaatgcagcaactgttactggatggcgccaggccggaaaatctgccgctctatttcaatcggatggtggatacgaagcaggatatcttattgatccactcagcaacaggccataatgttgcgattaatcatagcggcatccccgaccaacgctttaacgagattccgctggctaaaaacatcacccgcgaaaccttatttcgccaggcggtacaaggcacggagctgaccgcggtacgagtaaacgccagaagcggcgataacccgctgacccttactattgccaggctggcgacggaaaggcggcaaatgctggcgcaatatcgccgcaacagtttgctgattagccttatcgcgatcctcgtctgttcggcgctcagtccattagtcatcagaaacgggctgcgggccattacgtcgctcagccgactcaccgcggcgacagatagcggcacacttcgccagccgctggcggaacaggcgttacccgtcgagctcaggccgcttgggcaagcgctaaataccatgcgccagaagctttccgacgattttgaacgcctgaaccaatttgccgacgatctggcgcatgagctgcgcacgccggttaatattttactggggaagaatcaggttatgctgagtcaggaacgcagcgccgaagagtatcaacaagcccttgtcgataatattgaagagctggagggactgtcgcgactgacagaaaatattctctttctggcacgcgcggagcaccagaatatagcggtaaaaaaacagcctgtttcgctcaatgcgctggtcgaaaatatgctggattatcttagcccccttgccgaagagaagcacatctgttttataaatcaatgtcagggaacggtatgggctgacgaaatattattacaaagagtgctctcaaacctgctgacgaatgccatccgttattctgatgaaaacgccgtgatacgtattgaaagcgcttatgatgataacgttgcagaaattcgggtcgctaatccgggcagccccaccgccgatgcggataagcttttccggcgtttttggcgaggagataatgcccgctacactgccggtttcggcctggggttatcgttagttaacgcgattgccctattgcacggtggctcggcatcttaccgctatgccgatgaacataatatcttttcggttcgtctgcctgatagcggtgatagctaaggtcagtacaggttctgttccccttccctgccacagggctgtggttatcaatacaacctcaataaaaagaaaataaaggatgccggtaaagaatattgctggctcgatcactttctcggtttccaatccagggtcaattcatcccataacgcgttattcagtgggaacctttatgaaaaagtatcttgctttcgccgttacgctgctgggtatgggtaaagtcatcgcctgtactacccttttggtaggcaatcaggcttcggctgacggctcctttattatcgcgcgcaacgaggatggctcggcaaataacgccaagcataaggttattcatcccgtcgcgtttcatcaacaaggcgagtataaagcacatcgcaacaattttagctggccgcttccggagacagcgatgcgctatacggcgattcatgactttgatactaacgataacgccatgggtgaagccggtttcaattcggcgggcgtcggaatgagcgcaacggaaaccatttacaacggcagagcggcgctggctgccgatccttacgtgacaaaaacgggaatcacggaagacgccattgagtccgtgatcctgccagtggcgcaatcggcgcgtcagggcgccaaattactgggagatattattgaacaaaaaggcgcgggcgaaggtttcggcgtcgcgtttattgatagcaaagagatatggtatctggagacgggaagcggacatcaatggctggcagtacgacttccggcagatagctatttcgtttccgccaatcagggacgtttacgccattacgatccgaatgataacgcgaattatatggcgtcaccaacgttagtaagctttgcgaaaaagcagggattatatgatccggcccgcggcgaattcgactttcatcaagcctattcgcaggataacaaaaacgataccacctataattatccgcgcgtctggacgctacaacaccagtttaatccgcatctggatacggtcgttagcgaaggggaaacattttctgtttttttaacgccaataacgaagatcagcgtggcggcagtaaaaaacgcgttacgcaatcactatcagggaacgtcgcacgacccttatgccagtcataatccacaagaaccatggcgacctatatccgtttttcgtacccaggagtcacatattttacaggtcagaccgaaattaccgcaggctatcggcaacgtagaatacatcgcctatggaatgccatctcttagcgtctatctcccctattaccaggggatgcgtcattatcaacccggagatgataaaggaaccgatcgggcgagcaacgactctacctactggacattccgcacgctgcaaacactggttatgcaagactacaatacgtttgcgccagatgtgcaacatgcctggaaaacatttgaacagcaaacagctaagcaacagtataagatggagcagagctatctgagattatatgcgtcgcatccgaaagaagcacaacgcttactgcaaaattttgaagataaaacgatgcaaaatgcgcagacgctcgcccgtcgcctgaccaataatattattacgacaatgacttaccgcacagatatgaaatatcacttttcaagtacgcagccataaatttaatgacaatctattagccactcatacacaataagataaagcggtaccagaattagccagatataaaagacaataattattatggattcatagagaggatagtttatgacactccagacaaatatcagcagagagacaaaagcggcaaagacccaggaggtatataagcacgttgttcttttcaaaatggccgccccctcttacataagacgataactacagcttatgtcccgtgttacataacttttcccgacaggcctcttttacccatgctgaaaaattccgcgtcttttcagatttcaacgcgaattctatctgttcaagcatggaataggaaaaacgaatattcttcgtcacggtcttactcgtccggggctttgctggcatacacacacctgtataacatttgatgtaacgccgttactttacgcaggagtaaatcggtgaatttgatctgaatcaagaaggtgggttttcaataaaagttgtgccctaaattgtgaagtttgtagattttatgaacatttgatgtaccgatctcccccatgatcgccactacgtatggacgtcaggatgcctccccgcctgatcagaagcgtttcctcattaaaaaggacatttttttaaagttcctggtgcataaaagtcacatccttttaaaagattgttaaccctgttgaatgttcccactcccctattcaggaatattaaaaacgctatgcaaatacagagcttctatcactcagcttcactaaaaacccaggaggcttttaaaagcctacaaaaaaccttatacaacggaatgcagattctctcaggccagggcaaagcgccggctaaagcgcccgacgctcgcccggaaattattgtcctgcgagaacctggcgcgacatgggggaattatctacagcatcagaagacgtctaaccactcgctgcataacctctataacttacagcgcgatcttcttaccgtcgcggcaaccgttctgggtaaacaagacccggttctaacgtcaatggcaaaccaaatggagttagccaaagttaaagcggaccggccagcaacaaaacaagaagaagctgcggcaaaagcattgaagaaaaatcttatcgaacttattgcagcacgcactcagcagcaaaatggcttacctgcaaaagaagctcatcgctttgcggcagtagcgtttagagatgctcaggtcaagcagctcaataaccagccctggcaaaccataaaaaatacactcacgcataacgggcatcactataccaacacgcagctccctgccgcagagatgaaaatcggcgcaaaagatatctttcccagtgcttatgagggaaagggcgtatgcagttgggataccaagaatattcatcacgccaataatttgtggatgtccacggtgagtgtgcatgaggacggtaaagataaaacgcttttttgcgggatacgtcatggtgtgctttccccctatcatgaaaaagatccgcttctgcgtcaggccggcgctgaaaacaaagccaaagaagtattagctgcggcactttttagtaaacctgagttgcttaacagagccttagagggcgaagcggtaagcctgaaactggtatccgtcgggttactcaccgcgtcgaatattttcggcaaagagggaactatggtcgaggatcaaatgcgcgcatggcaatcgttgacccagccgggaaaaatgattcatttaaaaatccgcaataaagatggcgatctacagacggtaaaaataaaaccggacgtcgccgcatttaatgtgggtgttaatgagctggcgctcaagctcggctttggccttaaagcatcagatagctataatgccgaagcgctacatcagttattaggcaatgatttacgccctgaagccagaccaggtggctgggttggcgaatggctggcgcaatacccggataattatgaggtcgtcaatacattagcgcgccagattaaggatatctggaaaaataaccaacatcataaagatggcggcgaaccctataaactcgcacaacgccttgccatgttagcccatgaaattgacgcggtgcccgcctggaattgtaaaagcggcaaagatcgtacagggatgatggattcagaaatcaagcgagagctcatttctttccatcagacccatatgttaagtgcgcctggtagtcttccggatagcggtggacagaaaattttccaaaaagtattactgaatagcggtaacctggagattcagaaacaaaatacgggcggggcgggaaacaaagtaatgaaaaatttatcgccagaggtgctcaatctttcctatcaaaaacgagttggggatgaaaatatttggcagtcagtaaaaggtatttcttcattaatcacatcttgagtcttgaggtaactatatggaaagtctattaaatcgtttatatgacgcgttaggcctggatgcgccagaagatgagccactgcttatcattgatgatgggatacaggtttattttaatgaatccgatcatacactggaaatgtgctgtccctttatgccactgcctgacgacactctgactttgcagcattttttacgtcttaactacgccagcgccgtcactatcggcgctgatgcagacaatactgctttagtggcgctttatcgcttgccgcaaaccagtaccgaagaagaggcgctcactggttttgaattattcatttcaaacgtgaagcaattgaaagagcattatgcataatttaatacgtcaacatactttcttaatgagataaaacgcgatacgtatgccctttacaagagacaaaaccagaatctttggtggaaatgtaaagggcaaacgttcctctttctcattttgctctgtttgcgggagcatttttagtgtgtaagtattcctgctcatcaggtttttacgccatctacgcacatttattctgctataagttgaaatgctgcaaaaaatattaaagcttattattttttctttaagtaaattttcgctcaacaaacttaattgtttattcaatgatgatgaggcgtaagctatgctggaaatgaaggaagtcaatagcaaggataatcttattattcacgggtgatattacttctgcttcaccgttatggcagatatcatcgcctcttgtcagatgccagacacctactcatactcaaccaaagctctaaatacaaaaatcaccttatatctttttttattattccttgtataaatgtgacttgactcacacctataaggaatcgactcacttccataagaaggaatcaaaatgccaataactaacgcgtccccagaaaatatattaagatatttgcatgcggccggtaccggtacgaaagaagcaatgaaaagtgcaacttcaccacgcggtatactggaatggtttgtcaatttttttacctgtggtggagtaagaagaagcaatgaaagatgcttttgggaggtaattggaaaactgaccacatcattattatatgtaaataaagatgctttcttcgatggtaataaaatatttctggaggatgtcaacgggtgtactatatgtctgtcatgtggagcagcatccgaaaatacggatcccatggtcactattgaagtgaacaaaaatggaaaaactgtaacggataaagttgatagtgagagattttggaatgtatgtcgaatgttaaaactgatgagtaaacataatatacaacagcctgattcacttataaccgaggatggttttctgaacctgcgcggagtaaacctagctcataaagatttccagggagaagatttgtcagacatagatgcttctaatgcagatttccgtgaaacaaatctatctaatgtaaatttagtcggtgcaaatttgtgttgtgcaaatctacacgctgtaaatctaatgggttcaaacatgactaaagcaaacctgactcacgcagacctgacttgcgctaacatgtccggtgtaaacttaaccgctgcaattctattcggctcagacttaactgacaccaaactaaatggtgcaaaattagataagatagctctaactttagcgaaagcattaacaggagccgatctgacaggtagtcaacatacccctactccactcccggattacaatgataaaacgcttttcccccatccaatattttagtcgagataaagggattttataaacaagaagtattcaaacagaagccctccttgttttattaaacaaaccccgcccctaagcttcattataaataacattttcagcgtattacttgttggttttgcctgaatcatagcgttatctgtatgtggcacattaactaaaaacactattattgtttaatttaaataattcataattgcagtcagggaataagaaattatgcttccggtcacctacagattaatacctcaaagcggagtatccacatatggattaaataccgcagatacacctgttttccccgatattcccgaacatgcaccaaacccctcacggctacgccttgctcatgacagccttgccataaacagtgaattccgtctggagccagagtgtgtggtggagtaccttatctcaggcgcgggtggaatagaccctgatacagaaattgatgacgacacttatgacgaatgctacgatgaactatcctccgtacttcaaaatgcgtatacccaaagcgaaacattccgcagactgatgaattacgcatatgaaaaagaactacatgatgtggagcagcgctggctaccgggggcaggcgaagcctttgaaactaccgtggctcaggaacacttcaaactttcagaaggcaggaaagttatttgtctcaatctggacgattctgatgattcatataccgaacattatgaaagtaacgaaggaagacaactttttgacacaaaacgttcatttactcatgaagttgtacatgcactgacccatcttcaggataaagaagaaaatcatccaagaggccctgttgtcgaatataccaacattattctgaaagagatggggcatccttcacctcccagaatggtctacatcttcaataaatagacacatcaagaaacgaaaagaaactaaaaacccacgtagtccgttttttcgggaaatgttctagcagtattttctaactatattctaagcgcccaaaaaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaacaaaggggttacctttcggtaaccccttgtttaatctggcggaagcgcagagattcgaactctggaaccctttcgggtcgccggttttcaagaccggtgccttcaaccgctcggccacacttccagaatgaggcgcactataaacatcccggtgcgtcatgtaaagaccgaatgtgttcgtttgcgtgaaaaacaggcaaattttcgttaattgcctgaaatagcggcacattgaccatttcttcaacacaaaaacgggctgaatacgtgttgatcgtccccactgttttacctctgtgattatcaattttttatcggtaacgcgtggttggcgctgccgcctgttttatggcgtagcgccaggcatgagcagaccgttttaacgacggtaatcacctgaaatctcttaaggaaactaaacgtaaacgaatgcgtaaagatgggtaaaaccactgggtgacagtgactgtttttattattctcctttattaattacatctgtcataagagagtgactaatggatcgtatcattacatcatcgcgtgatcgtagctcgctactgagtacgcacaaagtactgcgcaacacctattttctgttgagcctgacgctggctttctccgcaattaccgcgacagccagtacggtactgatgctgccctcccccggcctgattctgacgctggtcggtatgtatgggctgatgttcctgacctataaaaccgccaataagccggtcggtatcctgtctgcttttgcgtttaccggcttcctcggctatatcctgggcccgattcttaacgcctatctgtcagcaggcatgggcgatgtgattggcctggcgctgggtggtaccgcgttagtatttttctgctgctccgcttacgttctgaccacccgtaaggatatgtctttcctgggcggtatgctaatggccgggatcgtcgtcgtgctgattggtatggtggcgaatattttcctgcaactgcctgcattgcacctggcgattagcgcggtgtttatcctgatttcctcgggcgctatcctgtatgaaaccagtaacatcattcacggcggtgaaaccaactatattcgtgcgaccgtcagtctgtacgtttcgctgtacaacatctttgtcagcctgctcagcattctgggcttcgccagccgcgactaatcgacattcccctcttccagccctgcttatgcagggctttattttttgctacactgccgtccgtgttgattacgcagtgaaacgttatgttgatctttgaaggtaaagaaatcagtactgatagcgaaggctatctgaaagagacgacgcagtggagtgaagcgctggcagtcgctatcgccgccaatgaaggcattgagctctctgcggaacactgggaagtcgtgcgcttcgtgcgcgaattttacctggagtttaatacctctcccgccatccgaatgctggtaaaagcgatggcgaataagttcggcgaagaaaaaggcaacagccgctatctgtatcgtctgttcccgaaaggcccggcaaagcaagcgaccaaaatcgccggtctgcccaagccggtaaaatgtatttaataccgaatactaaatcctgttagcgtctcgcgagggctgtgcggttcagtgaggattttgtccacacgagcagagcgcggtccgccttctttcagccacttgatgagcttttctacctgcgccgcgtcgccacaggccaccacttctacgcttccgtcatccatattcttcgcatagccggttaaccccagccgctgcgcctcatgctgcgtggtatagcgaaacccgacgccctgaacgcgaccataaacccaggcgataatgcagacgttcgacatgatggttctcctttcataatcaacggtgaagacgcatacaggacatacttaacgtacctgactgggcagacacccataatgttggcggaatctggccgtaaatcgcgaccccgacaggtagccgcaccgtagcgctatttcgccgatcggcagcgtcgtcgattgcagttgagaaagcgcgcaggacatgcgtacctcttcaataatttgccgataactctgcgattcgcgctgcaaacgccgacgcagcgtcgatgttcccatagcaaggcggcgggctatctcctgggctgtccatagcttagcaggtgagagcataatcagttgccgcacctgctccgtgagggtgtaacgccgttcaataagcagcggtcccgccgcgccatcatgtaaaagcgctaacagtaaccccatcgcctgatgttcctgtagcccaacgggcaacccctggcgcacagcatccaacacgttctcccacataaatgtcaggctacggctcatcggcgtacacagcgatgtcaggtttgccggtggataatcctgaacatacatcgttttaaagcgagcaataatctccggtgaaagtaacaacaggtcggagcgaaaaccgttctgcgcaggctgattaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaataatctccagcggcgtgttcgccggaataataattaactcgccaggcccggcgacaaggcggctatcatcctgaatgatgactttactgccctgcgtaatatggcagatcgcggcggaaaaaagcgtaacacgatgcaaacggtgcagatgactggaacgcacctctgccgtcgtaagatcctgatgtcgaatatgcatctcctgcaccgtgccgtcctctgttttaccttccgtatgtggccgtgaattgtgctttcgcaatcacatgcgcgttaagcataaaccctaccaacgcgccactcgactcactgtcgagcggcagtgttgccgtattcagcgcccacacagtaaactgatagcgatgaggctcatcgcccggcggcggacaggcgccgccaaagccagcataaccgaaatcattccgtccctgcaccactccagcgggtaacgttttttatcagcccccgtcggcaggtcgtgaatctgcgcaggaatattcaccatcgtccagtgccaccagccgcttccggtgggagcatcaggatcgaagacggtaatagcgtagcttttggttccggcaggcggattgcgccagctcagctgcggcgaaatattttctccgctacaaccaaatcctttaaagacgtgctgttgcgttaaacgaaaatctgccggaatatccgcgctactgaggctaaacgccgacgcggcagatacgccgccactcaatgccatcattgcggctgcggtcaaagagaagactgttttcattgtatttccttcttcatgtaaagaaataacactataaaaagcgtccgctgaagaaactgtgcctttacgattctattttgtgcagaaacgctcaccgccatacgctggtgattgcccctctcatctgtgctaccctacgcgccatttcgttttcacggtccctggctggaactatcatccggctcgcgtcactgtttgtgagaggttactccgcatgactgaatctacatttccgcaatatccccgtttagtcctcagcaaagggcgagaaaaatctttactccgccgccacccatgggtcttttccggcgccgtatcccgtctggaaggcaaagccaacctcggtgaaactatcgatatcgtcgaccatcagggaaagtggttagcacgcggcgcctggtcgccagcctcccagatccgcgcgcgcgtctggacatttgataaaacagaatccattgatattgcgtttttcacccgccgcctgcgccaggcgcagcagtggcgcgactggctggcgaaaaaagacggtctggatagctatcgtctgatcgccggtgaatccgatggcctgcctggcgtcactatcgatcgttttggtcattttttggtgctgcaactgctcagcgccggggccgaatatcaacgcgccgcattaattagcgctctgcaaacatgctatccggattgcgctatttacgatcgcagcgacgtcgccgtgcggaaaaaagaagggatggcgctgacgcaaggcccggtcactggcgaactgccgcctgcgcttttgccaattgaagaacacggtatgaaattgctggtcgatatacagggcggccacaaaaccggttattatcttgatcagcgcgacagtcgtctggtgacgcgccgctacgtagaaaatcagcgggtactgaactgcttctcttataccggcggttttgccgtgtcggcgttaatgggtggttgtcgccaggttgtcagcgtggatacctcacaggatgcgctggatatcgccaggcaaaacgttgaactgaaccaactggacttgagcaaagccgaattcgtgcgcgacgacgtgtttaagttgctgcgcgcttaccgtgaacacggcgaaaaattcgacgtcatcatcatggacccgcccaaattcgtcgaaaataaaagccagttaatgggcgcctgccggggctataaagacattaacatgttagcgattcaactgctcaatccgggcggcatactgctgacattctcttgctccggactgatgaccagcgatttatttcagaaaatcattgccgatgccgcaatagatgccggtcgtgatgtacaatttatagagcagttccgtcaggccgccgatcacccggtgatcgccacctacccggaagggctgtatctgaaagggtttgcctgtcgcgtcatgtaacttgaaaagtggaatagtatcctcatataaagggtatctatttcccgggaggtgactatgatagccagcaaattcggtatcggccaacaggtccgccattccctgttaggttacctcggagtggtcgtcgatatcgacccggaatattcgcttgatgagccgtcgcctgatgaactggcggttaacgacgaacttcgcgccgctccgtggtaccacgtggtaatggaagatgatgatggtcagccagtgcatacttatctggccgaggcccagttgcgaagcgaaatgcgggacgagcatccagaacagccatcgatggatgaactggcgcgtaccattcgcaagcagcttcaggcgccgcgactacgtaactgattgtatgtaaaaggccggagagcgatatccggccatttaaacttttatttcgccagccccaggcgagggatctcaatcgccgggcagcgatccatcaccacagtcatgcctgcatcccgcgccagtaccgccgcctgttcgttgatcacgccaagctgtagccacagcgtttttgcgccgatggcgatagcttcctgcgcgacgccccatgcagcttcagagttgcgaaaaacatccaccatatcgactttttcgggaatatccgccagcgtggcatacccctgttgccccagcaatgtcttacccgcgacttttggcgcaaccggaatcacatggtagccctgttcaagcaggtatttcattacccgatagcttggacgatcgggtttatcgctcgcacctaccagcgcgatagtgcgagtggacgtcaaaacatcagcaatatcggtctctttcatcatctttctcctggctgttttgcaaagtgtacgacaaacctgacatagcaaccattcatcccataccgatgtatgagagcaaaacgccaaaatatgtctatatgttagtaaacatgatctaagaaaaatttcgatacattattagccagacggcctttggacaggagaaccttatgaaaaccggcgcgctagccaccttccttgctctctgtttgccggtgactgtttttgccacaacgctccgtttgtctaatgaggttgatctgctggtgctggacggcaaaaaggtgtccagctctttattacgcggcgcagagagcatcgaactggaaaacgggccgcatcaactcgttttccgggtggaaaaaaccatccgcctgcccggtaatgaagagcggctttatatttctccgccgctggtgataagcttcgatacccagctgataagtcaggtcaattttcagctcccgcggctggaaaacgagcgcgaagcctcgcattttaacgcggcgccgcgtctggcgcttttggacggcgacgccatgcccattccggtaaaactcgatattctggccattacttctacggctaaagtggtcgattacgaaatagagaccgagcgttataataaatcggcgaaacgcgcctcgcttcctcagttcgccacgatgatggcagacgacagcacattactttccgacgtctcagagcttgataccgtaccgccgcaatcacaaactctgacagaacagcggctgaaatattggttccgactggccgacccgcagacacgccatcattttctgcaatgggcggaaaaacagccgccctcttgatatgagttgtcccagcgcgcaatttttttgtctttctcttgcagcatcaagcgcttccagtaatctgtagacaggttaactacggaatcgaattatggaactgacgactcgcaccttgccgacgcgcaaacatatcgcgttggttgctcacgaccactgcaaacagatgttaatgaactgggtggaacgccatcagccgttgctggaaaaacacgttctttatgcaaccggcaccacggggaatctgatccagcgcgcaaccggtatggacgttaatgcgatgctgagcggcccgatgggcggcgaccagcaggttggcgcgctcatttcagaagggaaaatcgacgtgttgattttcttctgggacccgcttaacgcggtaccgcacgaccccgatgtcaaagcgctactgcgtctggccactgtatggaatatccctgtcgccactaatgtctcaacggcggactttatcatccagtccccgcattttaatgacgctgtagatattcttattccggattatgcgcgttatctggccgagcgcctgaaataaccgctacgcgggcgggatgctataccgcccgcgctttagggcttcctcgccaccggcacatccagctgtttaagcgcctccacaaagcgcgagggattatctttattgaaaagcagccagacccgcgcacgcgcgcgcgtcaacgccacatataacaaacgccgctcttcagcgtccggaaaatcctcaacctgaggaaaaagcgcactttccataatggattctcgcgccggggcggggaaaccgtcgttaccctcctgcaatccgacaagaatcacgtaatcggcctgttggcctttgctggcatggatagtcatgaaatctatctgtaacttcggccagcgagtcgccgctttttgtagactcgcgggtttcagatggtgatagcgcgccagcaccaggatacgttcatcctccttcgcatagccggataatttatccagtaacgcgtccaactggctttcatccaataacgtaaccgcttttttatcgcctggggtcagactatttaacggttttttaagttggtgcggattctgctgtacaaagcgattggcaatatcgccaatccgactgttaaaacggtacgtggtgtccaggtgacaatgctcgccctcgccgaacgtctgatgaaacgccgtcgttaaggagagctgcgccccgctaaaacggtaaatcgcctgccagtcatcgccaacggcaaacagcgtagtctggctattctgcttgcgtagcgcctctaacagcgccgcccgttgcggggaaatatcctgaaattcatcgaccagaatatgcttccacgggctaataaaacgccctttttcgaggatcaccattgcctgatggatcagcccggagaaatcaacggcattttccgctttcaatgcgcttttccaggccttcagcagcggcgccatcaacttaatgcgtttgccaaacagctcgcggcactcctctggcgcgccagcgatcatttctgcctgcgcgccgccgtgcatacgcatcaaactgacccaacgatccaggcgaggggccagacgccgctgcaatgtctcatcgtcccagaaattaccttccggcactacccactgcatctcctcttccagccactgacgccagcctttggcctgcgcttttttctcgctacactgctgacgccaggtgtgcagaaatagctgatgccgcgcggtggcgtcactttccagcttactgacaaccggcgcttttttactgccttgctgaataatatacagcgccagcgaatggaacgtacgggcagtaatctcttccgtatgtaagcgctcgcggatacgctcatccatctcttctgccgccttgcgaccaaacgccagtaaaagaatttgccccgcatcggcttgcccgcgcgccaacagccaacccgcgcgcgccaccagcaccgaggtcttaccgcttcccgcgcccgccagtaccagtaacgatgattcgccgttaaccaccgccctggcctgggaaggattaagcggagaagattctatctgcgtaaaaaagtcggcatgcgcttccagcatggcatcagcatacgcctgattatgctgctgccgacttccctcgctatcctgtaaccatgccagacacttacgccatatctcgcgacagtgagcaaactcctccagacgtgagaccggcagcggtaaggcggcaaacgtctggcgaatttcgtgttccagcccacgaacgtgttcacgggtaagccattggtttccgcccgttcgctcactaatacgcgcccattgctcctgtaatgcctgcgcggcgacatcactcatctcctggctccagcgacgccagtgcgcgtccagatagcgatggaattgctgggtttccgaccactcggtaccgtgcaaacgcacgactttatcctccgggaggacaaactccagctcgccccataccagcccacgcttacagtgaatcgccaataactgattgaatggaataagatattcatgcctgtcgccagacactttcaccccagcattgaggatcacggcacgatcatacgggtgttgcgccagacgttttccaagagaagttgctttcagttccatgactcagcgaatccagacgtaaagatgtgcttatcagtgtaaccgccagagaaaacgtgctccagtctaaaaaaacgttacaattgcccgcagtaatagaaaaccggaatgaactgagggtttatgcgtaccgttctgaatattttaaactttgtactgggcggctttgccactacgctggcctggctgctggcgacgctggtcagtattgtgcttatttttaccctgccgttgacccgctcctgctgggagataaccaaactgtccctgttcccttacggtaatgaagccattcacgttgacgaacttaatccggcggcaaaaagcgtattaatgaatactggcggtaccttgctgaatattttctggttactttttttcggctggtggctatgcctgatgcacattgcctccggtatcgcgcagtgtgtcactatcatcgggatacctgtcggtattgcgaactttaaaattgccgcgattgcgctttggcctgtcggtcgccgcgtcgtctctgtagaaaccgctcgcgccgcgcgagaagctaacgcgcgccgccgttttgaatgatcgggacaaatagcctttatgttaagtccgttgattcgccgttatacctggaacagtacctggctgtattacatccgcatttttatcgctctgtgcggcaccaccgccctgccctggtggctgggcgacgtcaaactgaccatcccgctcacgctcggtatggttgccgcggcgctaaccgatctcgacgaccgccttgccggacgcttgcgtaatttaatcattaccttaatttgcttttttatcgcgtcggcttctgtggagctgctctttccctggccgtggctatttgcgttgggcttaacgttatccaccagcggatttattctgttgggaggactagggcaacgctatgccaccatcgcgttcggcgcgttactcattgcgatttatacgatgctgggcgcttctttatacgatcactggtatcagcaaccactgctcctgctggcaggcgcagtatggtataacctactgacgctaaccgggcatctgctatttccgatccgtccgttgcaggataatctggcacgcagttacgaacagttggcgcactatctggaactgaaatcacgtctgtttgatcctgatattgaagatgaaagccaggcgccgctctatgatttagcgttagcgaacgggcagttaatggcgacgctgaaccaaacgaaagtgtcgttgttgactcgcctgcgcggcgatcgcggtcaacgcggtacgcgccgcactctccattactattttgtggcgcaggatattcatgaacgcgccagttcttcgcatattcaataccagacgctgcgcgattattttcgccatagcgacgtcatgttccgctttcaacgtctgatgtcgatgcaggcgcaggcctgtacgcagctggcgcgctgtatcttactgcgtacgccgtaccagcatgatccgcgctttgaacgcgtctttacccacattgacgccgcgcttgaacgtatgcgcgccagcggcgcttctttagagctgctgaatacgcttggattcttattaaccaacctacgcgctattgatgcgcaactggcgacgatcgagtcggagcaggcccaggcaatgccgcgcaatgagtcagaaaaccagttggctgacgatagcctgcacgggtttagcgacatctggctgcgtctgagccgtaattttaccccggagtccgctctctttcgccatgcggtacgcatgtcgctggtattgtgcatcggttatgctctcatccaaattaccgggatgcgccacgggtactggatattgctcaccagcctgttcgtttgtcagcctaactataacgcgacccgccatcgccttgcgctcaggattatcggtacgttggtaggcgttgcgatcggcctgccgattttatggtttgtcccttcgcttgaaggacagttagttctgctggtgattaccggcgtgcttttcttcgcattccgtaatgtgcagtatgcccatgcgacgatgttcatcaccctgctggtattactctgctttaacctcctgggcgaaggcttcgaggtagcgttaccgcgcgtcatcgacacgttaattggctgcgctatcgcctgggctgcggtcagctttatttggccggactggcgctttcgcaaccttccccgggtactccagcgcgccaccgatgctaattgccgctaccttgatgcgatccttgagcaatatcatcagggacgggataaccgcctggcctatcgcattgccagacgcgacgcgcacaaccgcgatgcagaactggcatccgtggtttctaatatgtcgagcgaacccgacgtcacggctgaaacccgggaggcggcgttcaggctgctttgcctcaatcacacttttaccagctatatctccgccctcggcgcgcaccgcgaaaagctcagcaatccggacgtgttggggcttctggatgacgcggtctgctacgttgatgatgcgcttcatcatcagccagaagacgaacagcgcgtacaccaggcgctggagggtttaaagcagcgagttcagtcgctggaaacacgtccggacagcaaagaacctctggttgttcaacaaattggtttgctcattgccttactgcccgagattggacgcttgcaacggcaaatttcaccgccgacttctacattaattacccagccgtaagcgaatgagcccagtcggcaagctcctggcgacgactcgccgggagcgccgcttcatgtacgccgacaattgcgccttccagggcatacaaaactttcaccgtcagcaagggattgctttgtcgcaaccttaaccagcacattttcgcgcccagtatgcgtaacatattttcgtcctttatccctgactcattgagcaatgtttccagatggaaggtcatattggggagatctttgagtctgtgctgtaaaatacggctgtgtttttccttcattgccgcgtcaagagaatacttcgataaacgtaccagctgctgctgatcgcgccacaggctttcatccacccggtaatagttgagcataacgggacgtccacatttcataaacatgagccaggcggggggatgcttcacacagtagggtacgctttcttcacaggcgcggagataaagctcgccattagccaccatcgcaaagacggtatcctccacagtcagactatagctaccgaataaagatcgatactggatcgtccccaaagaggccaaatattcttgcgattcatagatcctgtcataagagagtgctctcataaaattccttttaaatcataaagtaaaagaatgatttgcagtaacggatccgttaatgacgaaaataggcaacttatactccgcgagcaagatgatttttatttttgacgccactaagaataaaaattgcgagacagtttccgaaaatagagttgatctttcatcgccacaggagtactgtatgaatatacagtaactcacagggctggattgattatgtacacttcaggttatgcaaatcgttcttcgtcatttcctaccactacccacaacgctgcgcgcaccgctacggaaaatgccgcggcaggactggtcagtgaagttgtctaccacgaagaccagcccatgatggcgcaactcctgcttttgcctttactccgtcagttaggccaacaatcacgctggcagctctggctcacgccgcagcaaaagctcagccgtgaatgggtacagtcttcaggtttgccattaacgaaagtgatgcaaattagccagcttgcgcctcgtcatacgctggagtcgatgatccgcgctttgcgtacaggaaattacagcgtggtaattggttggatgactgaagaactgacagaagaagaacatgccagcctggttgaagcagcgaaggtaggtaatgcggtagggtttatcatgcgccctgtacgtgcgcacgctttacccaggagacagcattccgggctaaaaattcactctaatttgtatcattaagtaaaattaggatttatcctggacttttttttacgcgaacgtatctcctttgagtgctaacgtttttttgcgagaacgcttgccagaagcggtttccgcaatctttgctgtacgatttatcatccgaaactgttaaatgatgtgtatacccgtcatgttttttcacatgtctgacggagttcacacttgtaagtttccaactacgttgtagactttacatcgccaggggtgctcagcataagccgtagatatcggtagagtaactattgagcagatcccccggtgaaggatttaaccgtgttatctcgttggagatattcatggcgtattttggatgataacgaggcgcaaaaaatgaaaaagacagctatcgcgattgcagtggcactggctggtttcgctaccgtagcgcaggccgctccgaaagataacacctggtacgctggtgctaaactgggctggtctcagtaccatgacaccggcttcattcacaatgatggcccgactcatgaaaaccaactgggcgcaggtgcttttggtggttaccaggttaacccgtacgttggctttgaaatgggctacgactggttaggccgtatgccgtacaaaggcgacaacaccaatggcgcttataaagctcagggcgttcagttgaccgctaaactgggttatccaatcactgacgatctggacgtttatacccgtctgggtggtatggtatggcgtgcagacaccaagtctaacgtccctggcggcgcgtctactaaagaccacgacaccggcgtttccccggtattcgcgggcggtatcgagtatgccatcacccctgaaatcgcaacccgtctggaataccagtggactaacaacatcggtgatgccaacaccatcggcacccgtccggacaacggcctgctgagcgtaggtgtttcctaccgtttcggccagcaagaagctgctccggtagtagctccggcaccggctccggctccggaagtacagaccaagcacttcactctgaagtctgacgtactgttcaacttcaacaaatcgaccctgaagccggaaggccagcaggctctggatcagctgtacagccagctgagcaacctggatccgaaagacggttccgttgtcgttctgggcttcactgaccgtatcggttctgacgcttacaaccagggtctgtccgaaaaacgtgctcagtctgttgttgattacctgatctccaaaggtattccgtctgacaaaatctccgcacgtggtatgggcgaatctaacccggttaccggcaacacctgtgacaacgtgaaacctcgcgctgccctgatcgattgcctggctccggatcgtcgtgtagagatcgaagttaaaggcgttaaagacgtggtaactcagccgcaggcttaagtttccgtctgataaaaaaccccgcttcgcggggttttttgctctggtctgggtggcaacgcctttcagcgttacttcttgcctaataacgcctgtaaatcctgctttaacgtggtcatttgcgtggcatatttctctttatgctccgcgtcttctatcagttgcacaatcgtttcggataatgttttaccgcgtcgctgcgcaaggcccgccagacgctgccagaccataaactctaaatcgatagattttttgcgcgtatgctgatgctccgcattgaagtgtcgtttgcgtcttgcccgaatggtttgtctcatccgattaagcaaggcaggattcatatgcctgtctatccagacatttacccgcaccggttcattttcgagggccaacaacaaattgacggcttcctgggcagcactggcttccacgtagcgggtgatcaactccccttcgcggtgctttttcaccagatatttccatttccaaccgctttcaagattttcaagttgttgatatttcattgtgatcccaatgttaccgtgtaactgttatcagaatatcagttttttagccatctgaagaaaagaatctcgaacctgtgaatggttacacgtcttcatattactttgcattcgctttccgcgtgtgcagcgtgacgggttaggctataatccccccttttacaacagactaaaaaacctcaactttgaccattacgaaacttgcatggcgtgatctggttccggatagcgaaagctatcaggagatatttgcacagccacacgcgactgacgaaaacgacaccttactcagtgatactcagccacgactgcaatttgcgcttgagcaacttatacagccgtgggcatcatcctcttttatgctgactaaagcgcctgaagagcaagagtatctcactttactttcagatgccgtccgcgctctgcaaaccgatgccggacaattaaccggcggacattatgacgtttccgggcatactgttcattaccgcgccgcgcagaatgcgcaagacaactttgccaccgtcacacaagtcgtcagcgctgactgggtcgaagccgaacagctctttggttgcctgcggcagtataacggcgacattaccctgcaaccgggactggttcatcaggcgaacggcggcgtgctgattatttccttacgaacccttctggcgcagccgttactatggatgcgtctgaaagccatcgttagccgcgagcgttttgactgggtggcctttgacgagtcgcgtccattaccggtctccgtgccatcaatgccgctcaaactgaaggtgattctggttggcgaacgtgaatcactggctgattttcaggagatggaaccggagctcgcggaacaggctatctacagtgaatttgaagacaatttacagatagcggacgcagaagctatgaccctgtggtgtcaatgggtgacgcgtatcgctttacgcgataatttgccccctccggcaccggacgcctggcccgtcctgatacgcgaggctgtgcgctataccggcgaacaggatacgctgcctctttgcccactgtggatagcccgccagtttaaggaggcgtcgcctttatgcgaaggcgatacctgcggcgcagaagcgctcagtctgatgcttgcccgacgcgaatggcgagaaggctttctggcggagcggatgcaaggcgagattctgcaagagcagatcctgattgaaaccgaaggcgaacgcgttggacaaatcaatgcgctttccgtcattgagtttcccggacatccgcgcgcctttggcgaaccgtcgcgaattagctgtgttgtgcatatcggcgatggcgaatttaacgatattgagcgcaaggccgaacttggcggaaatatccacgctaagggaatgatgattatgcaggccttcctgatgtcggagttgcagctggagcaacaaattcccttctctgcctcgttaacctttgagcagtcctacagcgaagtggatggcgatagcgcctcaatggcggaattatgtgcgctcatcagcgcgctggccaatgtgccagtgaatcaaaatattgcgattaccggctcggtcgatcagtttggtcgcgcgcaaccagtgggcgggctaaacgaaaaaattgaaggtttcttcgccatctgcgagcagcgggaattaaacggtaaacagggcgtgattatccctgccgccaatgtccgccatctcagtcttaaatctgaactgctgcaagcggttaaagaagagaagttcactatctgggcggtagacgacgtgaccgacgccttaccgctactgttaaatctggtgtgggatggcgaaggtcaaacgacgttgatgcagactatccaggagcgtatcgcgcaggcgacgcaacaggaaggccgtcatcgtttcccgtggccattacgttggctgaacgcttttattccgaactgatcggacttgttcagcgtacacgtgttagctatcctgcgtgcttcaataaaataaggtttacataaaacatggtagataaacgcgaatcctatacaaaagaagaccttcttgcctctggtcgtggtgaactgtttggcgctaaagggccgcaactccctgcgccgaacatgctgatgatggaccgcgtcgttaagatgaccgaaacgggcggcaatttcgacaaaggctatgtcgaagccgagctggatatcaatccggatctatggttcttcggatgccactttatcggcgatccggtgatgcccggttgtctgggtctggatgctatgtggcaattggtgggattctacctgggctggttgggcggcgaaggcaaaggccgcgctctgggcgtgggcgaagtgaaatttaccggtcaggttctgccgacagccaggaaagtcacctatcgcattcattttaaacgtatcgtaaaccgtcgcctgatcatgggcctggcggacggtgaggttctggtggatggtcgtctgatctataccgcacacgatttgaaagtcggtttgttccaggatacttccgcgttctaagtgttgaattgatattccgcgctatcggtatcatgcttgcaaagcccataaaggcgaaacctccgcactgcggaggtttctttttctaaagagacagaatcaggccattaccgccctgtcctccatggcttgtcgccaacctcccaaccagtatgaccgttgattcagcgtctgatagggacacatttcttttgatcgtccggcgatgccggcctgatatccacgttgatgtgcccgttccaggcgatctcgtttttgtctcctcatgcctcgtttccctcatatttgtatctggtggaaaagaaaacagtgattacaaaatgtgcaatcacactacacgaatacctctaaatggatcgcccgtcaatgcgcaaaattcacaccaatgtcatatttgtgagctatacggtaaatcatttgtacaaaaaatgtgagccataacaactatttttccggcgtcaaaaataaaaaccgcctcaggcgcacgacctgaagcggttaaatttacattatttttatctcagggaaggcgctttatctcatctgcgatagcggccgcttcctgactccatgcgcttgccagtactttgaccatctcatcatagccatctttctgctggctggcttcgatatggaaaggccgcttaatcagttgtccgttgtggtttaataaccactccccgctgacgataaccttaccatcgtaacgtccatggaatccggttacggtaacgttcaacgtatcctgggtggttcccaacggctgggaagcgacgacccagccaggaagccgggcgctaagattcgccaccagcgtgttacgtaattgctgatccagcgggctggcccacagattgttattggcaatcacatactggacatcactggtttgatacaccacaccgttacctgccagatagtcaggtacggaaacctgctctacccataagagacggttgccctgacttgcggtgctttgcacaccgctttgcgctatcgggagctgataatagcttttattttctccgccggaactacatgacgccagccagaacgccattatcacgactagccattttttcattgtttcgccctcttaggctcaggatcttttttatccttcgcttcaaataccagcgcgttgctcttctcgttcagagttttcaacaccggttgtaactcacgaagcacctgatcgagacgctgcatatccgccaccattttgttatacgccgccgatccaggctggaagccctgcatactgcggttaagttcgcgtaacgtcgtttgcatatccgccggaagctgctgcatcgactgactggaggtaatcttgttcatattatccagcgtggtttgcaaccgacgcatagtacgctggctttcagacagcgtattggtcgcttgttcaatcatcggattcagcggcaggttgttgatcttatccaacgtttccaccagtcgctgttgaatttgcgccaggccgctgctgacggtgggaataatttcataaccatcaaattcgcgtagtccggtaatcggcggctccttaggataaaagtccagatcgacatacagcgccccggtcaccaggttaccggttttaagcgaagcgcgtaaaccgcgcttaagcagttccgtcaaatgcgcgccaacatccgcattttctcccagttgcgctttcagacgctccggttcaatgcgcaccagcacaggaatacggtaatcgtcgttaaacacctgacgcatattagacgcaaagaaaggcactttgcttaccgtccccagacgaataccgcggaactccagcggcgcgccgggttgtaatccgcgcaccgaatctttaaagaacatcaggtaatcgatatgatcggtgtacagcgaatcctgaatacttttttgatcgtcgtagagattaaacgccgttttttcggcgacgggttgcccctgctcaagtccttccggcacatcaaaactcacgccgccgccaaataacgtcgtcaacgatcccatttccacgcgcattcccgccgatgtcagatccacagcgataccgctatctttccagaatcggacattactggtgaccaatcgatcgtttggcgccttaatgaacaactgataactcattgtccgtttttgcggatcgaaagagctggtttcaacggaccctacccgatagccccggaacagaacgggatcgccaggactgagctgaccggcctttttgctgtccagaatcacacgaatacctttggcatcgggcggcgccaacggcggtgagtcaagaagctgatagctttccggctgactgcccttacttcctggttgtagttcaatatacgcgcctgataacaacgtcccaagcccgcttatgccttcacgccccacctgcggttttacgacccaaaataccgagtctttatgcagcaacttttccataccggaatgaagccgcgctttgatttgtacgtgggtcagatcgtcagtcagcgtcgcgctttcaaccacgccgacatccacgctgcgacttttgatcgtcgtttttccgccttcaatgccttccgcattggtggtaattaaggtaacttccggtccctggtggctgtagtgataaaacagaatccaggctccgataagcgcagtaacaatcgggaatatccagacaggcgaccaatttttcaccttttgtactttggcttccccttttttaggttccatgctatcaggactcctcatggcctggttcgtattcacgatcccacgacagacgcggatcaaaggtcatcgcagaaaacattgtcattatgacgactaaagcaaacatcaacgcacccatcgcaggataaatattcattaaccctcccatacgcaccagcgcagagagtacggcaatgacaaagacatcaatcattgaccagcgccccacaaactccactacttcataaataaaatgcatccgttcactgtcgcgcttaccgtggcctttcgcatcccaacaaagccaggcaatggcgatcatttttagcgtcggcaccataatactggcaagaaagataaccgccgccactggataagacccctcgctccacagcaaaatcacgccagccagaatggtcgacggcattttcgagcccagtaagtcagtaatcataatcggcaatatattggcgggcagataaagcatgatcgaggtaaataataacgccagcgtccactgcaaactgtttttacgccggacatagcctttcgtatggcaacgcggacagacgagactctccgcaggcaggatcgccgtacagcaggcgcaagaacgcaaagactgccggataccggtaatccccggcgttaacggctgcgccagtgcaggttgcggggcgatatcatcccacaaccagcggcgatcgacacactggaacgcccgcagttgaacgagacaaaataagcaccagggaataaagctgctgccgatgccgatatcgccgtaagccatcagcttaacaaaactgaccaacaccccggcgagaaatatttccgccattccccacgatttgaggaggaaaaagatccttgccagcgttttttttaccgacaacggcagactggcgcggttgacaagtaatagaatggtcaccaggcaaaatgccggcaccagttggacaaataataaaaagaacgtgccgaggctggcgtaatcttcagaaaacatgacgccggggatttccagaagcgtgacttcgctggtgacgcccgcgacattcatattcacgaagggaaaaaggttagaaagcagcaacataaatagtgccgctaacgcataggcggtaggacgctgccggggcgcgtcccactcggtcgttaacgttgcgccgcatcgtggacatgctgctttttgcccatgcgagaggcggggtaaagccaccagcatgtcgcattgcgggcacaatatgtgcttcgcagcatggtgatgttcacacataggcgctcctttcgttatgccccgtttttcaggccttcaagatactcccaacgttcgaaggcttgctcaagttcttgctccgcctgacttaaatcggccagaactttctgcgtttgctcatggggttggctaaaaaaggccgcatccgcaacctgcgcctgtagcgcttccagcttcgcttccaggtcttcaagctgaccgggtaactgctccagctcgcgctgcagtttatagcttagtttgctactgccacgttttacaatttctgctttaggggcaataacttcctcattttttttcgtcatcggctgtttcgtcgccagatgctgctcttgctgcgcacgcgcatcatggtagccgccgatataacgtccgattttgccgccgccctcgaaaatccagcattccgtcacggtattatcgacaaattgccgatcatggctgaccagtagtaccgtgccctgatagccatcaattaattcttctaatagttccagcgtttcgacgtcaagatcgttcgttggttcatcgagaattaaaagattgctcggcttgaggaacagtcgcgccagcagcagacggttacgttcgccgccggaaagcgcgcggacgggcgtcatcgcccgtttggggtgaaacaggaagtcctgcaaatagcccagtacatggcgcggcttaccgtttaccatcacctcttgcttgccttccgcaaggttatccatcacggttttttccgggtccagttcggcgcgatgctgatcgaagtaggcgacttccagcttcgttcctacgtggatgcgcccgctgtcagcctgaagctgtcccagcatcagtttcagtagcgtggttttaccgcagccgttcgggccaattaacgcaatcttgtcgccgcgctgtacctgagcggagaaatcttttaccagctgttttccttctacctggtaatcgacgttttccatctcaaaaacgattttaccggagcgcgtcgcctcttcgacctgcatcttcgccgtgcccatcacttcccggcgctcgctgcgttcacgacgcatcgcttttaacgcccgcacgcgcccttcattacgggtgcggcgcgccttgatcccctggcgaatccagacttcttcctgtgccagtttgcgatcaaattccgcgttttgtaactcttctacgcgcagcgcttcttctttctccagcaggtattgatcgtaatttcccggataggtgaccagtttgccacgatcgagatcgacaatgcgggtcgccatattgcgaataaacgaacgatcgtgagagataaaaataatcgttccgttaaaggttttcagaaacccttccagccagtcgatagtttcgatatccagatggttagtcggttcatccagtaacaatacgcgcggattgctgaccagcgcccgacccagcgcggctttacgcagccagccgccggagagcgacgacagcgcggcgttaggatcgagtccaagctgcgccagcacttcattaatacggttttccagctgccacagattatgatgatcgagctgttcctgtacgcgcgccatttcattgaggtttttctcgctgggatcggtcatcaccagacgggaaatctcatgatagcgcttgagatattccgcttgttcttcgataccttcggcgacaaagtcatagacgctacccgcaatattacggggcgggtcctgttgcagacgcgcgacgatcagatcctgttcataaataatacgcccatcgtccagaccctgttcgcggttgaggatcttcatcaaggtggatttcccggcgccgttacgccccaccagacagacgcgttcgttatcttcgatatgcaactctgcgttatcgagaagcggcgcgtcgctgaacgacagccatgcgccatgcatactgattaatgacatttacttttcctttcaggcggcgcggatcagccagcaattatgaatctgacggttacgggcaaaatccggggaaagcgttttttgcgtaatttcttgtgcggtaagccccagctcagccagcccttccagatccatacggaatccgcgcttattatttgagaacatgatggtgccgcctttacgcagcaggcgttttaaatctttcattaacgcgacatgatcgcgctgaacatcaaacgactcttccatacgttttgagttagagaacgtcggcggatcgataaagatcaaatcgaactgttcattcgcctcgcgcagccagcccaggcagtcggcctgaatcaggcgatgcgcgcggccgctcagtccgttcagacgcaaattacgttcggcccactccagataggtgcgggacatatccaccgttgtggtgttgcgcgcgccgcccagacccgcatgtacgctggcgctgccggtataagaaaagagattcaggaaatctttgcctttgctcatttctcccagcattctgcgggcaatacggtgatcgaggaacagaccagtgtcgagataatccgtcagatttacccataagcgcgcattatattcgctgacctcaaggaactcgcccttctcgctcattttctgatactggttttttcctttttgccgttcgcgggtttttaacaccagtttattcggcggaataccgagcactgacaaggttgccgcaataatatcgaacagacgttgccgcgctttttgcgcatccaccgttttcggcggcgcatattcctgaatcaccgcccagtcgccgtaacggtctaccgccacgttatattccggcaggtcggcatcatacaagcgatagcattcaatcccttcctggcgcgcccatttctccagctttttaagatttttacgcaggcgattagcgtaatcttccgccaccgtcgccggtttactgtccgccgtggtttccgcaatatgatagtttttctgcacacagtccagcgggccattcttggctttaaactgtttgtcggcgcgtaattgcaggctgcccagcaaatcgggcgaagcgctgaacagcgacaggttccagccgccaaactgatttttcatggtacggcccaacaggctgtgcaacgcaatcagcgccggatcgctgtccagacgttcgccgtaaggcgggttactgatcaccgtaccatacgggcctttcggcaatggattactcagttgcgccacatctttcacttcaaaagtgataagctccccgataccggcgcgacgggcgttgctgcgcgcccgctcaatgacgcgcgcatcgctgtcggaaccgtagaaatgagaggaatactccgccagccccttacgcgcccgggtctgcgcttcggctttcacttcctgccagatagcctcgtcatgctgcgcccagccgctaaatccccagtgaccacgatgcaggcccggcgcgcgatcggtcgcccacatcgcggcctcaatcaacagtgtccccgaaccacacatagggtcgagcagcggcgtacctggttgccagccggaacgcataacaatcgctgccgccagcgtctctttaattggcgccagcccggtgcgatcgcgataaccgcgcaggtgcaggccatcaccactgagatccagcgcaatgctggccgtttctttattcagccagacgttaatacggaggtccggcgattcgcggtccacatttggacgcggaagatttttccgcgtaaacgcatcgacaatcgcgtctttaactttcatcgcgccatactgactattacggatggtgtcgttcaggccgctgaaatgcaccgcaaacgtcgcgccaggattaaaaatctctgtccagtttatcgcctgaacgccgaagtaaagatcgagatcgctgtagaccttgcactcacccatcggcaggataatacgcgaggccaggcggctccacatcaggctctggtaaataagccgcgtgtcgccctgaaaatggaccccaccctgaacaacctgacaccctacggcgcccagtttttccagttcaatttttaacagctcttccagcccgcgggccgtactggcaaacagagaattcatattgtcacttttacgctaagaaaattgttgcgcattatagctaatctcacgcccatgtcataaagttgaaggcttattttcatttgagggactgtacggtggcgacgttatcacggctctttattcatccggtcaaatccatgcgcggcattggcctgactcatgcgctggcagatatcagcggcctggcttttgatcgcatcttcatggtaaccgagtctgacggcacatttattaccgcccgccagtttccacaaatggtacgttttaccccctctcccttacacgacggcctccatttgaccgcgccagacggcagcagcgcgctggttcgctttacggatttcaccccgcaggatgcgccgaccgaggtctggggaaaccattttaccgctcgcgtcgccccgacggcgattaatcaatggttgagcggctttttctcccgcgatgtccagttgtgctgggttgggccgcagttgacgcgccgggttaaacggcataacgcggtgccgctgggatttgccgatggctacccgtatttattgaccaacgaagcctcactgcgcgatctgcaacagcgttgtccggcaggcgtacaaatggaacaatttcgcccaaacttagtggtttccggcgtagcggcctgggaggaagatagctggaaagtgcttcgcattggcgatgtgatttttgacgtcgtgaagccctgtagtcgctgtatttttacgaccgtcagccctgaaaaggggcaaaaacatccttccggcgaaccgctggcgacactgcaagcttttcgtaccgcccaggacaatggcgatgtggatttcggtcagaatctgattgcccgcaatagcggcgtcattcgcgtcggcgatgaggtggagatactggcgacagcgccggcaaaagcttatggcgccacaacgctcgacgacagcgttacgccagagaaacacccggacgggagtgtaaccatcgactggcaggggcaaaccttctgcgggaataatcaacaggtgctactggaacagttggagaatcagggaattcgtattccgtattcttgccgggctggtatctgtggttgctgccggatacgtttgctggaaggcgaagtaagtccgctgaaaaaatcggctatgggtgacgatggtacgattctgagctgtagctgcgtgcctaagaccgcgttacgactggaaaattaaaccgcttgttcaaggctgaaactgtgacagtgaacctgcggtttcagcctgtcgttcataattttaatcgcatcgccaagctgcatggttcggcctgctatcaccacgcctggctgtgccagcagacacaacgcggcattttctcccggctcaacgaccagcaaattaacctgttccgccgtatcgcttaaccagacgcttgcggcatcacccgtgcccggggtccacatttcgccatgcgccacaaaatgccagcttttcggcatctgcggtttgagatagcgaatcgccaccagcgcattcaataccagctccgcgcgttgctctttggttaattcgaaatcccggcatttttcttcaaaggaaaaatagagcgcggcatcatccacacaaaaaccggtcgggcaaaacgcgtccggcgtaagcattttacgagagaagcgcgagcgaaaaagcataccattggcgagatcgagcatcatacgatcgtgctcttcatcataataccagcgccagttatcgtcaggtttaattcgcatcacctctctcccgcttttaagcaactcgtaacagcattgtccttttgccgcttcgtttattaccccaataataaaagcctaaaatgtctaaataagcaacagtggagaaatataaaacaaccagtgccggaaataaagccctggttgtctgataaagggtaaagtttagatgtgcgttacgatttctttaatcaatggcgggcctttaaaaataaagccggaataaatttgtaccagcgtagctcctgccgctatcttctcgcgcgcggcgataactgagtcaatgccgccgacgccgataataggcaattgtccttttaactccagggataaacggcgaataatttctgtgctttttaattgtaatggccggccacttaatccccccgtttgctggcaatttttcattccttgtaccagagaacgatcgagggtggtatttgtcgcaatcaccccatcaatattatgacgaagcaggctatcggcaacctggatcaattcttcttcacaaagatccggcgcgatctttactgccaccggcacatatttatggtggatcacctgaagatcgttttgcttatttttaatggcagttaacagatcgtccagcgcatcgccatactggagcgtacgtaaccctggcgtattcggcgaagaaatattaatggcgatataacccgcataagcatagactttttccatacaaatcaggtagtcatctttgccattttcgacaggcgtatctttatttttaccgatgttaattcccagaataccatcaaaatgggcttttttaacattctcgaccaggttatcgacgcccagattattaaagcccatccgattgattagaccttcagcatccaccagacgaaaaagacgtggcttatcgttacccggctgtgggcgcggcgtcacggtgccgatttccagggagccaaaccccatcgcgcctaatgcgtcgatgcactccccgtctttatccagaccggcagccagccccagtggatttttaaaggtaagtcccatgcaggtaaccggctttgtcggtactttctggcgcaccagcgcttccagcggcgtacctgtaatgcggcgtaattgttgaaatgtaaattcatgagcgcgctctggatcgagctggaaaagggctttacgaacgaagggatagtacatgaactctcctggattcccggtgtgcaaaccgggggcgtattatgggcgataacaaagcaaaagggaattgacctatggcaataaatagcaatcgttttccttcattctcacttcacgtttcgccaggaagcgtcatcatccggcaaaaaaatacccggcagcgctaacgcttaccgggcatgttttacctctttataacggatactgtcaggctaacgctttagttatcttctcgtacagatcgccggaaagattctccagtccttttaactgctccagcgccgcgcgcattttctcctgacgcttatcatcataacgtttcagacgaatcagcggttcaatgaggcgagatgctacctgcgggttacggctattcagatcggtcagcatctcgaccaggaactggtatccgctaccgtcttgcgcatggaacgccgccgggttgctgccagcaaacgcgccaattaatgaacggatgcggttcgggttgctcatactgaaagaacggtgtttgagcaggctgcgtacggtttccagtacattttccgccgggcttgtggattgcaggataaaccatttatccattaccaggccgtcctgatgccacttatcgtcatactcctgcatcagcgtatcgcggcacggcaactgcgccgccactgcagcagacagggccgccagcgcatcggtcatattattggcgtcgcgatactgtttgctgaccagcgtattagccagctccgtctcgccgaacgtcaggaagcgcaggcaagcattgcgcagcgtgcgcttaccgatatcgccgtgatcaacacgatactcatccagatgattggcgttatagatagccaggaactcatccgccagttctgccgccagcgtacgcgttagcgcttcacgaacttgcgcaatggcgatcgggtcaatgacctcaaacagctccgcaatttcattggccgaaggcagcgttaaaatttctgcggccaacgccggatcgattttctcatccaacagtactgcacggaacgcatcagcgacatgcaccggaagcgatagcggttgcccctgctgatgacgcgccacattcagtttaatgtatgtggccagcaggctttgcgccgcatcccaacgggagaaatcattgcgcgcatggcgcatcaggaacgtcaactgctgatcgctccatttatattccagcttcaccggcgctgaaaactcgcacagcaaggccggaacaggctggaagtagacattatcgaaggtaaatgtctgctccgcctgcgtgacgttcagcacggcattgaccgggtgaccgcctttttgcaacggaatgacgttgccttcgttatcgtacagttcgatggcgaatggaatatgcagcggctgcttctccgcctgatccgccgtcgccggagtgcgctggctgatggtcaacgtgtactgctcggtttccggattataatcatcttttaccgttacaatcggcgtgccggactgactgtaccagcggcggaaatgggacaaatcgacattagaagcatcttccatcgcctgtacgaagtcatcacacgtcgcggcgctgccgtcatggcgctcaaaataaagctgcatccccttctggaaattttcctcacccagcaacgtgtggatcatgcgaatgacttccgcacccttttcataaacggtgagggtgtagaagttattcatttcgattactttatccgggcggataggatgcgccatcgggctggcgtcttccgcgaattgtaaaccgcgcatggtacgcacgttactgatgcggttcaccgcgcgtgaccccaaatcagagctaaactcctgatcgcggaacacggtgagcccctctttcaggctcaactggaaccagtcgcggcaggtgacgcggttgccggtccagttgtggaaatactcatggcctatcacgcgctcaatatcgagataatctttatccgtcgcggtatcggttcgcgccagcacgtatttggagttaaagatattgagacctttattctccatcgcgcccatattaaagaaatccaccgcgacaatcatatagatgtcgaggtcatattcgagcccaaaacgcgtttcatcccatttcatggaatttttcagcgaggtcattgcccacggcgcgcgatccagattgccacggtcaacgtacagttctaatgcgacttcacgcccggagcgggtggtaaaggtatcgcgcagcacgtcaaaatcaccggccaccagcgcaaacagataacacggtttcgggaacggatcttgccactgaacccagtgacggccattctccagttcaccctgcgcaacacggttgccattggaaagcaggaacggatatttgcttttatcggcaataattttggtggtaaatcgcgccagtacgtccgggcggtcaagataccaggtaatatggcggaagccctccgcttcacactgggtacagagcgcatcgccggactggtacaatccttccagcgccgtattcgccgccggacttatctcgttgacaatgcgtaacgtaaaacgctctggcaggtcgctgatgataagcgcgccctcttcttccttatatgctgtccacggcgcatcgttgacgtggatagataccagcgttaaatcttccccatcaaggcgaagaggcgcatcaggcgcgccatgacgaacagcctggcttattgcggtgaccacggttttttcggcatcgaggtcaaaggtcaattcaatatcagtaatctggtaatccggcgcgcgatagtcatggcggtatttggcttgtggctgttgtgtcataaaaaacctttcgcatctttgtgtagagtgtcgactccagtctattcctgttgcgcaaatcgcgctacgcagaatgttcatcttttcaggcacaaacggcctatttgctacatttttataatatgtactcatagtttttaaaatcgataaagatcgtccaggagcgctttaaacaagggatgagcgagatcgagataaagctttattaacgaactttaacgaacttcacagaccacttttgccccatccatgccccacacataattttagtcaacgccagaccccatcagccctgcagggcaaatcgataacaaacacgcccgcagtatgttccccaaaatttaaaaacaagtggttcatgccttgacagacaaaaccgccaaagcaaaatactgtatataaaaacagtggctggcgaagcacgtatgttcgtagaactggtttatgacaagcgtaatgttgaaggactcgaaggggccagcgagatcattctggccgaactgacgaagcggatgcaccagattttccctgatgccgaagtgagggtgaagccgatgcaggcaaactgcttgaatagtgataccaacaaaagcgatcgcgaaaagttaaacaggtggcttggctggtttcagattacgcgggtaggatcagatcactccaaataccgacgacatagaattaggaattcagtgatgaatcaatgatggcaatacactgttcagaatgccatcgcgtatatgcgagcacagtgcccgtattagagaacatcggagacgggaagtaaagtatcggggtctggtagaccaggctgatgcaacgaagccagcctggccagtcatctgtaattggttgagagggcggagtcctgcgtaccatgagtaagataatcgtctaaaaccgtaaatttttaatggaataagtcttaatctgtacaaaggcatattgcttttgatatataaaccccctcaatatagacgtgcatttatatcaatgattatttaaaggagtagtgaagtatgttcttaacatttcctaatgtagcaataactcgagataacaggatagacaaattatctgaaaatgatttagaactcattcgtgatacggctatacaaaatggcggaagaaagatacaggtacaattacgtgatttattatatgaagtaagtaatcgtgctgttgaaggtgataataatacattcaaagttagtttttctactacagaccgagccatgtttagggaacgtcatattgaatggcagggaaacgctataaggttagaacgacaattaaatactggactgaatgtgtcgcgtggaaattttttaaatatgtcgaccacatcattttccaataacagtcaggagttagcagcccacagttcaccaggagcacctgctatttttgatacatctaataaacaacaattagtggataagattgatttatgcagtttctcaccaaatgttgatgaactttcatgtacggaagacaacttaacatgcccggtaatgttagttgttcctgaaaaaggcgtttttgtaaaaactgggccagagtcaaacatatgccaattatttgatgaaacagcacttatccaacttattattgacggtgccacacatcctgttagtagggctccattatcactagatatgataataaataaaaatgaatgttattttgacactaccaaaggtaattttataatcccataatccaaatattactaatacctttatatatagagcaactctattagagttaggctattttctaatcactccggcagtctatgtttcgatgttgattgctggagatttaccttccctatcatcacctcctggcttcacttcatgatgctttccggaacctttctgtacagcgtcgacagtctcacatcataaataatcgctacctgctgtcgcggtacccctgccctcgctgcgcccattgctccggggtgagctttggacgtctgccaccaatacgcccctgctcccttgccgctgccagcccggcgcgggttctttccacaatcagtaccctctccatggtaaaccgggtggatacctcaaattctgactggccggataagccagccagtcagtagtcgttaccgtgacaatttaattatccatatatcacaaaatcacttgcttacgcggtaattaatccatttggttaataaaaagttatttcgtttaccagcatattttatcccatggtagttctgggattaatgtatctggcggccagattttacaccacggaaacgaaatacctgggaatcctttattaccgctttcagtggccattgcagatgaagaaaatgttatgactgatatggcaaaaaccagcgctaacaatacactgttaagtttattcataatatcactcacataattgatagctatgcttcatccttaacttttaccgcaatccttttatcaggataaagcagaaaagaaagttttccttgaatatctcttgattgttaagtaaatatttagtttaaaagtaaataataagtacagtagttttttcttttctaaagaaaatttacttatatcttagtgacttcgtacagatacctgaaccgaattaacacctaaaaactagcaagtcagtagtagtcgttattgtggtaattcaggccacctgatttccgtgaaggtggctgagtctttcacgccgctcaaatccagcgttttaagcgccctgatatacgccatccatttagtcaggctgtccttatcgtcgtcaccgatttcacccaacgccagttcggttcgccagtcggcaatggtgctgttagcggcatccagtagtttctgtcgggtggtttcggccttagcctgatagtcaacgggaacagccagaacagtgccgttcgaatatttccagtcgccatagatattaaatccggctggtagtttattgacctcaacaactgaaaagccagccggatagagtcgcgacacatcttctgatacggaacggattatattttcagaatcaatgcacaacttatattttttcgtgaatttactcagcgactcataaaaatcctgaccatcttcactacgaaaatacagaaagctgttatcataatccgggtcatcaggaatgtatctggttacgttttttaattccattatattcacctaaattatccattaattgtacgccagccattacccacccacatttgtagcggtctatacgcaaatgtcacaccgtatgctgttgttgggtcatgtctggcctgtgttaaaaagcaaccagcaggcgcttctgctggtccatattcatctactttgccaggccatacaggagcaccgcgctggatattttggacataacgattatctgattcgccttttgtatatacgtttcctgatgttaaataacgggcgtcgaaattaccgtaattatccggaataacttgtccattaacaacaaactgaatactgccatcggtattacgctggctgtataaatgccatccctggtcgtcatccagctcaataaccgttggtcgatttccgtcaccccacaaatgaaattgagcattcagcacggagttatttgagctagtcatggtcattcgtttggcatcgcctgcgcgaatggctcccagaacctgcatttcaccgggagcgacacgaacggtgtgctggctattcgcaaacgtatccagtatcccatcgccgttctgtttaaaaccagtgtcattatcaccaagaacgatcgaattgccgcccagcgcattatcagtaccaatgcttagcggaccgttaagacgccctccggtaatcggcaatgcacccacatcactggctgacggtttatttgcggtgttgtagtcaataacccacgggcgactggtattcggtacagttccccagtcctggcgctttgcgttcgcgccaatatgggcataataatgctgaaaccagacgtctccgattttctcaacaaacagatatccatagctgtacaacttgctgccacccggataggtgggaaaatcaacgaccgtatcagaattcgacaccgccaccttccaccatccgggtgcattagctgatgccattgtgccgttatcggtaatttctccaacagcatcggcggaaatggcccccacatctgacgcccacaaagtgatatcaccggtcagtggtttactgttaacccgccgtgtcgccgggacggcattttttgccagatttatcgtttcgcctaaaccgaggtatgtgagaatatccgcaatactggcttttccgatgatgtcgcgcccaacagaagtaagatctgtctgtccggctgtatcattccccgtgaaatacggaagtttatctgcaccagtagccagaccagcgagcgccgtcagcgtggcatcaagagtctgaaaatccttaccgaacgcagcggacattttggcgataaagccgctcaggtcaccatcatcgagtacatcctttccgctcttactggctgtgtactgtgccagtgctgcagcgatgaagctcgcctgacgcagcgctttatttacctgtgcacttgatgccttgcccgcagtaaaaccagacaggagcgccggcagcgcttcccagtcaggctgtgatgtaacattagcacccttacccgtcgcaaacggtttaaaatcatttttagccatcagagtaatgtcccccatgaaccggcatcaaacccgctgatatattcgttatccatatcaaacccaaaaaacctgtttccttcagaaggcgtttccaccgaaggtatttcaatacttccgccccatacaccagcggcctttaccgtcagatacccttgtcgtatcgcagcaataagttcgagagagaccgatgaaatatctgtttcaggaaaaacccagatacctatggtcatatcctggttatcgacgatctgcatcttcagaccggacccgtccagtgcggcgtcaagaatgggaggcagggagtcgtttcttccgtcccagttgttaattgctatcttcgtttttagaacgatgcgataggtttcatcgctcagcgaggtataacccgaatccggatcatatggcccctgccagacgccctggtcatatccaagtccgtcagtgtcccaactgaaatagacaccgcttattggctggcttacaacacggcttaaccctatccactggccgagaatatcgagttgtattcctgtcgcataatcaatatcaaaagcgcttattagcccatttattgcggctgaggtttcagctaacggcctggtcactaaatcgatgtgttcaacgaatttaggttttgtcgcatgatagttagtaattaagtccgtatatttgctcatgctgccaccgtaataatgatattttccggcttacaggaggcagattcgtcgtaagcaatattaatattcgccgcatcaacggtttcaggagatttgccgatcagcaactcctgaatatcgtaatagcgcgcattaccaccactgacgaccccaaggttagcaggagaataaatccggctcagcagtacctggtcaccaatcatcagtctgttaatgtaatccgcaacagcctgctgaatctgcacacctatctgagaggtgtacccggcaaaaacttttaaggtgatttttccgtaaacagggacatcagttggtcgcgaaaaactgattatgtgaggattaccatatttatccggtacggttacggatgtttttccccaggtccggaccccctgccctttatttccccggatggtcctcgctatttcggttacatcgccaccatcaacaatggccgagatggaatgcggaggaagcccgttaccgtcagtctttcctgtatcattttcatagagcttgtggcgcgtcacaccagcaatattagcgatcgccccgtccacgccttcaaatggtgtgatggatggtatcgcgacactctgcccctgcctgatgcgcagttctgcgtccgtttctgcaggtgcgccaacggtggccgctgccgggttggttactgacgtccagccacgggtcggtgtattgatagtggtaatcgtcccggcaggagctgcaaccgctccgcttttggaacaaattgcagttgccgtcacggtgccatcaacaccaatcaccactgaatccggaagacgccagatcacgttattggtgtctttcacggtgccgttcgtaatggttgttcctgcggtgccagtgagcagtaaatccacggtagagttcgttgcacctttgcgcgcgataccgttaatttttacgttactggtcagcgctgcgccgtaacctgtagcaggtgagaagcagttatagacggaaatggctgtgttattggcatcgtgaatagctagcgccaccagcgccaccatctggccgtctttgctgtccggctccagataagcgtcactaccataaatctgctggaaatagctcgtcagggtatcgagtatcgtctggtaatcaggcgcactgatcccctcagcggttaccgttgccgataagccgagtgtgtccaaattgagggccatttatgcctcgctggttactgtcgttgttccgtagatagtgtcgatttcagcgaaaaactggacgcggcgcgtcgtcgtgttcactgtggtattgaaagagaggatggatttcacgccccgcgtttcgaggatgcgcttgcggatcgccagattgtaggtttccggcttttgcttaccgagcacagactgaatccacggtgttccctctgtcttatcgaggaaccactgcccgtaccacaatgcaaatcgtgtttttaccgcctgcgcgacagcttctggcgagttaatcagccaggtatcatcgccactaccaaaagtgtaatcaccttcggtatcttcgcgtcggtatcgcatgtctgacctccttattcaccaccatcggacggcaccaatcaggctcgaaagcccgaaaaggaaaaatacaatccatataagcaggaatttccagttgggtaatttttcgcccataactcgcaactccattatcagtttgctaaaatcaatcacatgttctcccttgccatcctcaaggtgtagaaagtaaaaagccccgaagtgttagcgcacccggggcttttgtctggttggtagtttttaattcggcgcgccagtattcccgccacccgtctgaacgccgctatgagtgtgcgtcatcaggctcttaccgcccgccttcacatcgtttgtcaccgtgacaggaccgagcatcgttgcgctaccgccgccctcacccatcccctgcgacagattgccgttaatggttacgtcaccgtttagcgtaatgatgggtgatgtgatcgtggttccgccttctgcagtagccgtcagcgcgccgggggttttaacagtaacgttatggcctgcggccacttccacaaaagcagccccatcatcggtacgcaattgtgcggcgctggtgctgattccgcttattttctgcgcctgcgactgcggcccgacgatacagaacgcatccgataaatcatgcacccgatcgtcgacaggctcctgtaccccgccgttctgccaccagaaatcgatgcagcgatcggcaaaaatcaccagacactcatcaccagctttaaccgggaacgttagcgtgcagccaccgccgcgaggaaataccaccggcacatccaccagcagcggtaatgtcgtcgactggctaacgccattcgaatccggctcatagcctttgatagcgggttgaacaactgcggttacggtgtcgggatcaaatgactggacgatgccaggcattgaaactcgcagtgcagacatgacagaaccaacaagccttgtatcagcctgttctttactgccgagttgagaggaaagtgaaactggcatattttctccagacataaaaaaacccgctcatcggcgggcttggtatggtagtcatagcttatgctgttaacgagtcgtcggggttattcatcattcggtccactagagcatctatctcttcagcatcttgtaaggcactaattgccgtaattcgattaattttgcgttcaagtctgtaatcagcatttacgcgctgagcatgtaacatctttaacttaatgccaattttacggactttatcaacatctacgccgttaactttagcagcctcaccgttacaaaaagctgtatagagtcgcatgtgagaaccgccaggtaatctctcaccatcagtatcatgggtaggcgtcagattgttagtgattctgagggctgaatgatacatgccgtagtatgacctgctgatagcattacgtgtccattgctcaccattgtgctgcaatgattctctggctaattcgagaaaacaattatgcataacaggcattagaagtctcctgcctggaaacaaccaacacactctgaattttccaaaccagcagcgatgagttcattggcaaggtcgttattcacttttgacaaaagtgctgggtcgtcagttttaatttctacgaaaaatgtgttcagctcattcatgacataaaaagcatgcgcaccagccagacgtaaacgatacttttcagcaatagtcatcatcaattggccgatcgccttaaggtcatgagaatgattctcatgatcgataagataatcaagcgactcattacacttgagcaaatcgtctgccttagcaacttccatcgcattaagcataggcattacctttttcagcaaatctaaatccacccaatacgcagcatttatagccacttcagaaagaattcgaggattacgcgagttgatcgctctcttaataatctcgtattgcttaacgtgataccccttgtttctcaacgcaatcgtatagttacaaaacgaaacagaatcgtccggggctatcgccaatgacttttcacaaagggcacatccctcttcaacttcgcctaaaacaagcttagctaatccctcgatagaaagcccttgataatattcaggaacattcctggcgtcacgaatgacggcatgaatttcaaactcactgagtaggttttctccctgagtgagtgagggaccaaggatctctaaaagctctccggatttaggctgcgctaaactcatttagttgtaattcctgactgggtgacatcaaagttgatggcaaaacgccttcaaaagtatctgcagtgtaatgggtaaagttggaaaacgacagcacgatgcgcacattttgctgattttcagaaagtttggttagctagaaatgtcaatcgatttagtttcaccgaggcaccttcttacaaggaaaagcgcgttcacttcaccttccggcagtcatacgtccagaactctcgcggctcgtccatatttttgcgaataacttcaacattgaggatcggcttgccatttctggccacaaagtccatccctaaccaacgtccattacccggaaccatccattggatgttcacattgtcataatcccctttttgtttgagaaaggtgattttctgtgtctccggtttctgtccattaatccttgcaagtccgtcttgcgctttccagttgatcgtgaatggtccgcacccggtatcagcaaaggaagtgaaggagatacagacaagtaaagctgccaacaatagtcttttcatgtgtatttcgccgcatcaatccctttcgagttaagcaattctttgccatctttagccaggcaaagcaggtccatataccacgcctgcccgcgagtgtcgccagtataatcgatgctgcccacaatgtaatcaccgtcagtattaatgctggcaggctgtgacatgccgggcaggccgttaacgtagagattaccgtcgctttccgattcatccagccgtgctggagattgcgctatctggtcattactcaaagaggtccggtagacagatgcctgatccagacgaataagcccacccagcttaatgtttggattaatcaggcacctgacgtttacgcctgcacccattgtttgctgaggcctaccgattagccctgtattggcattcagcaccgtagcgacaccgatatagttatcttccggcacaatgttgacctgattgttctcataccaccagtaagcgttacactgtccggcgatatgattcatcagcctggctgtgctctgatagacaacccgcccacgggggaagaccgtctcaggcatgtcaggaactgcacctgactcgataccataaggcccgaatgatttcatgcccaggctgaaaagatcactgtacttccagccggcagccactgtggttttcacactggcgttcaggtggccttcccaactgtcgatacactgcaacatgatccaactgtctgtcgcattatctttcccggtgacagtaaaacggatatctccgttgaatatcataccaacgttttcatcgggataattacccgttgcatccggttgtcccttatatccggctataacctgtatacgcgagaattccttctgcataatccggttctgagtggtaggggacaggttataaaccttaaaatttccaacgaatccattaaatatggtcgcaggcattttctgaatattgaaagtgactttaagctcagaaatttttatcccgtcgcccttatcgtcaaccagcaataattcaaagtgacgcatccagttttttgacattgttactccgtgaagacatagaggtgtgagaacgttccgagatcgaattgcgtcgggttttcctgtcctgccacgtcgcagagtaccaccagcgaaaacccgagattcatatatcgatactgcgccagcaggtcagcccccgtaatcatcggcatacctgagataatggcggaaccattgctgtcagcaagatccagaacccagtactctccgcgccagatgacagacaggtgataaaccgtaccgttaattgtggtggcaaaagtctgattatcagcgaccagtgggatttctacggcctccatgaatcaccttcccagaaataaattgctcagatacccatcgacagtggtgacacctttttgcgccatctgtggcagcgatttcagaatggaattattcggcggtaccgttgttttggtacctgtattctgtacagcagacgtccctactccctcggtcatattgtttttcgaggcaaccctgattgactgcgtggaggtaataatcacctccctgagggtaagggtcgccagaagcacattctcactgctcttgtcagtcgtcacctccagcgtttttatcaacatattgttgtaaatacgcttgccggttgtcacatcgaaaggaatacgatcccgctgcaggttaagcagctcctgatacagttctttcgggctcagccccagtgaaagaccaatagcggaagtatcagcaaaatcaagcagcgatccgcctccggaaaatccggtttccatcacaacttctgaagggcgcctgaatgcgtgttctgatatgtaaccagcgccctcaccactggcaccagcattcgtgggttgttcaaccggatgttccgtaatttccagagcgtcagtatgcttttcggtaataaccacatcaggaataattattcctatcgagcgggttcgctgctgcagcaaaacagataaaaaatccattacgcaggtcctttcaattgctgtaccgccctggcattgacagcaccctgcttgtcagcgatcagattagccgcttcctgaggattgttcacgccgtggacatttataacagtctgctggttaaggctaccaccagcggcctgatacgccagcgggctgttccagtttgaatacccttctttgcgcgccatcgactgcatcagcgcggccatagtttccgggttggcgaggttcaacacagtgttcggtgaaacgcccatccattttgcaacatcctgcgcatactttttcgggtcgttgttgtcaccagccggcgcccaggtactgacaatatcctgaatggtctgtaatgcccgcccggttgttttccctgtaaagtagcgcataagctggtttttcatcgcctcccagccctgaagggcggactcgaagaaccggaagccgttaccgcccaccgggcgaatgttacccggattgttgttcctgtcggctaaagtgcgctttgcggattgtgcatgttgtacaggttctgctccaggaatatccggctgaatattagcgcctttgacggtgtggggattgcggccaaaatcggtatcaatccccagtgcacgcattccatcgccaatgttttgtttggcataatcgatagacgactgcgcactggcgacgatattctcccgatcgtcatacaggtaagccgcgtaggccatccagccttttaaccacggcggcatcggtatacctgccagtctggcaaatgcgcccgttaccttgctaatccacgcaccggcgataaaggtcgccagcagctccagtgacgttttccagccgccaatagagtccttaagttcgagcaggtgatcacggagccagaccatcgcatccttcgctttgtctatcgctggctgccatttttcccagtcaataagactgttaccgccttctttccatgttttgtagtcttcccacaagagaccgaacgccacgatcagaccagtaatcagccctacaggcgacatccagaaagtagagttaagtatccgcatggcgacaaccagaccaccgataacctctatcagggttttcgtttctttatccagttttccccaccagtcgataatatcccctacaccttcaacaattcgaaacgccacgcgaccgatgatatccccgagcgtcagaataccttttatggctttcgtcagggtctgctcgatgcgcgggaagttatccaggatgtggcggcgcagcgtgtccagcgaacccgccagaccaccagcaagattagagccgatcttgtcacgggccaagcctgccatcgcgccgaactcgcgcagggaggtcatgaacctgttggagcttttggccgcctcgtcagcattgaaaccgatggcctttgccatcgcgctgtactggccggagaatccccctaaaccccggcgcatcgccataagggtattttcatcaatgcccagcatctgcgcatactggttagcccggtaatacggcatgctgctgagctcctggccgacgcccgtaaaaatggcggccatatcgcgcatattcccgctggcgtcccgggtctgtacgcccaggcggttcagaaagccttccgcgccgggattattacgcacaaaccgggagaggctttccagcgaagtccgcgccgcgtccacactaccgcccacctgcgaaactgcgtagccaatcgactgaatcccctgaaccgtcgcgccggtgcgttgagatgcccagtagagattatccagaccggaggcaattttcgccgtaaacgcaacaacggacagcgccgcaccttccaccgccagccctgtttttatggcatttgcggtgacgccagcaagaacagattcaaatttctcgtatccggcttcatcaatgccaaatccaagggagacgagaaaatctttaatagtctcagcgttcattaacctctctccatttatctacccgagcatcgttatcctcgcgcatgtcgaggtagtcattgagaagcgcgatgcggcagagatctaccgcgccgctgttaaggtctttctggtcaatatggaaggcgagaaccgggcgaagaataaaatcttcaccgcccggcaggctgttgaaggttattccgctggcggggtgggcgtcccgttggtagggagtccttgcaaaaaatttcccagagaatcggcgaccacccgcgccaccagctgcagcatggtcagcaggtcgatatcgtcaaacatcaactgaccgctgttaaacaccggggcccatccccccatatgtttgcgtgataccacagccaggcaaggatgaataatcgcgttggtatcttcttcggtcagggaagacagttcctcagcgatacgcggcagcagggtttcaaacaccggcttaagcgcatcaaacttagcgctgtcgattttgccatccgcaggcagaagggagcgaatgcccccgaaatctgacatcatgcccgccagcaccggcagcaatttacgggtgactttcagctggtcaaaaacgctgagtttcgccacgcgataatcgtggcctttgactgaacattccatctgttaaaactctccgagtacctggtcgattttgccgcagtcaaatacccagggcatcgtattaccggctttcgcgttggcgttatccggctgtttctggaaggccacactgcgcgccgtgatgatgtctccgctcaccttatttcggatcacaatgacgttgtttccccaggttcctgaggactgactctgtgcgttatacgccagcgacagttttttgtttgtcggcgaggtcttcagcagattgacagttaccgtaccgcttttatccgcgtgcaggctgtgcatcacttcgccgtcagcaccgatggtcatggtgtttttggggccgcccattgcaacggtgatcccctcctctgaactggcggaaccgtagcccaggtcaatctcgccagtcgggccagaaatggacgcggtgacatccataaaagaataagtagccattcattttccccttagcgaacgacgttgatctgtacgtcagcgaaatgcactgcgccagccagcttacaggaaacctgaataaccggtgccttacgtgcttcacggtctgcctgcgcctgctcggaaatcggctgcgcgtagacgtaatacccttttgtcagcgcgtctccggaatccagctgcccgattgggccaccgttccatacgccagcagccaccagcccgttcgtcacggactgatccatagactgctcaacattggacagaagacgtgtaacacccgcatcggtctgaggcactttggttgtactggtgtacagcaggttatacaggttggtctgaacgtagttctgcagccagtcgagcccgtggcgctcatcaaagaaatcaccgctggacatgacgccctgctgcaggattgccgtatcgttctggtagtacacaaacacgttgcagttcttggcatccagcgccgccgcctgatcagtcgtcagggtttcgtaagtgatccccggctcctgtttaaatttcagggtaatggtggtattgctgccgttgaaattcaccgtaaacgcgcggccaaacgcggacagcgcagcgtacttgctgctggaagaatactgtacgaacgtgcgcccgtattttgccgccttcagcttgtaggacagatccccggttgaagtggcgtcaaaggtggcgggatcgctggtggtaattgccagaatgcggctgacgcccgaagcttctacggctgcagcaaccttcagccagtcgtcatctgcaatatcctctttgtctgcaataccgagaccataccagttggtgtagcccattacggcgttaaccgcatccatcagcttttcagcagcacccgcctcacccgttgccagtgttttagcccagcgacctacatacacctctttaggtcgtggtgactgggagaaatagactgttgctgcttcatattcggggctgtccacgccgaaatcagatccgatgtcctcctttgaggagtagaggcgaagacgctctttcaccggaatgaccgtggatgtcccgagaataagcagtgaaccaaaatttcgaccagtagccgcgcgcggcccaatgatcacgtcgacattaacgacgtttgatacaggtaatccctgcggcataatttaatctccgaagaatgaaactggtgcatccaccagcgatttaatgccgtactcgcgcaccaccttgcgacgaaggcgcacagtaatgtcgtaacggcgaacccactgctggttgataagttccgggaaaggggtcagaccggtgtagtcccccatggacaggccaagcgcgttcagttcggcgttgttttgcgcaacagaaataccatcgcgaaaacgtgacgcaaacgtcatgcccgccgggccataaaatgacgccatgcactcaaaggtttcatgtcgccagagctgagcgccctcttcagtctggttagtgaatgcgggactgttatctatgggccatccggtaacgccgaacgcgcaccagttcgtttcagctggcagcagtggcggctgatctttctgccatcgggggcgaaccattccagtcggcaaaccggaaacgttgcgtacccactggcttaacagcctgtcgagcgcctcgtcataatccggatcgccgctgacaggtgtaagccatcccggctccgtactggaattattgctcaacgggaaatcctccatcgaacggcagcagctcgcaatgcgcctgtacaaagccggcgccatatgcggtgtacgggtcgacgaatgtcacacgataatcacggttctgatacgtcacgatatcggcatcacggccagtctgcccctgcgtgagtcgctcagtcgtcacgataaggattgctccactgataacctgcccggactgcatgcggcggttttccagtgaacggtcaacggtaacaaccccggcaaactgcgttttaacttcgctgtcgctaccaatcccgtcttcgtccactgtctgtacccgacgcgttacccaaaggttgaagtcacaaaaatccgggtcgaaaagaacatcggttacatcaagagtcggcatctttatccctcactacatgggttattgaggcgagatatttgccagtatcgtaaagaggcttagccaaagtggtgcccggagattcaccagcagcacgccgcgcaagttccgctttcgcacctttacgcccacggcgcgcacgcgcttcaacggtgctatctgcaagcggagtaaaattggcagctttgatgtgatttttcacccctcttgcagccactgtacctgcgcggttgagtgctctttccgctcccgccgcattaccatcaagcgcagcctgtgccgcagctttaagctgtggcatcgtctggtcttcaactgatttaacgccgggtacaagatgcggacgtggtgggatgttttgtgcaggtgaaccgtattcgttgatatacccaatcccggcattaccgaacgacacatcatcccgatcgctgtcttccgcaggtataccgaccagcacatcctttttggttagcgactttagcgcatccagtattgcctgagcgttatcaaccctcgttgttacaccgcttttgaaactcatagctggcgtccccctgcaccgaacatcgtgatcagctgataaaattcagcgccataccgggtgttattccagaagcctgcgtcagggtttagcgtcgcgctggtgtcatagctgacgcttaccttgtcaacggacttggaggactgaacaccattggttgaaccgcccggaccgccaaccagcatcgcccggctatctgccgcccagagcgtcatatagtgcgcaacgaacaactcggcaaagtacggaaacaactttttgccggtgacgttttcgctcagtagttcatcggccagattcagacggaactcgatttgtgcttcgggatatctggcagggtcagcaaactgcgggaagtcgcggcgaaaatcacttactgttggcaggctttgattctttggcatctttcgccccattaccgccagtccgggcggaagtaatctgcgcctgcaggctgtcgttctgctcctgcagcttgagcagagcgtctttcagatcggcaatcagtttatctttatcggcaatctgcgcctgaaggctgtcaataacgggttgctggtcatcagtttcattcgatccgctttcggaaagctcagcgtgcgcccgggtaaaccagtgcgacgcgacctcttctggtacgttatgccgtccccggccaaactcctgttttgactgatcaccgagcgtcagcgtaaacggggtgtgaacatggatggtaaccagcttttctttcgccatttttagtttccttctggcccctttcggggccattctggttatcagataccgtccacgtaggacagggtttctttgtacactggctcaaccgcaccgagcttgccgtagtaggtcgcaatctggtacagaccacgatactgaacaggaacgctttgcagcggaaccagtggatagcggacgtatttcttatcgttggtgtaggcgaccatacggtctttaccgccaaccccgcgccctttcagccatttgaccgctttgatttccagcggaacgccattctggtggaaagcgatagtgttcacagccagataagtcagcagtgactggttacccgcttcggaaaccttacggctcgccagcaatgaatactgctctggcggaatgcgcagatcagaaggcacgacggaataaccggatgctgcccaggcattcgacagaatgctgtttacgctgtcgaggatctcatcgttggtggagttagcccaggtcttcgttgcgttgttcagcgtcacaccaacgagattcgtcagacctttcaaaccaagcgcttcgtctccgacgtaaacctgttcgtcgttatccatctgccatttaagctgcatcccgtcgtacttctgagtgtcgatcggacggcctacctgctgtgccgcagccagctcaacaacagtccatcccagctccatcccccaaaggttcagcggattgccgtctttactgatatcaacattaacgccagcaatggcagttgaatctttgcctacccagtttttaccattcggattagcgccagaacccgccacgccaaaactggtattcgtccagctggaaatgtcatctgcgatagagacgtcttcgcgcaactggatatcacgtgtccaggtataacccaccagtggcagattcagcccctggtcgagtcgctccagctccccgatgagaaaggcaccggagctatcaacggttgcctgatcaaaagtaatcattcgtctgttccttaaatcttccaggagatttctgcgttgccgttagcgtcaccggcccccgtaaaaaaagcatcaggtaacgcggctgttttgcctgtcacctctgccgccgtgatcccaccaagcggaaccgggatggaagcatcggctgataccacgatgtacaccacgcctccttttttaacggacgaagcatcagtacccacgtttaccgtcatgtacccacgcttcatggcgtcgcccgggaaattcttatcagtacccacctggcgaaccatgtctggctgcgatgtggtcggatacggacgaacgtagatacccttcaccttgtcgacggtgtcaccctccgccagcggcacgaaaaagccgtcagcgtcgtatttgccagccagaccatacgctgcgaaggcgttatcggatttaaggatcaccggttcgacggttaagtcctgcgggcgagagatagccccggcaatgccaacaggcatccggtacagatatgcagtcattggattatcctttgcggttagaccagaagtcggcgttttgtttgttcagggaagcgatgctggtcatgcccatgcctggacgttgtgcatcgcccgtggtgctgcgggtgtttctcccttttgcaatctcagatacggcgttaaacgccatatcaaccgattgtttaggtaatttgcggatatcagcgtcaccgacaacctggcgaaccagtgttttgtctgcggccgccagcacatcacgtttaaatgcggtcggtttcaccttacggctcagatcgatacccgggataatgacttcagcgcgataggcagagtcacccgtaatcgtggtttcctcttcgttgtcctcgccgtcgccggtcgggtctttcttatctttatcatcaggggtgtcagcattatcgcctgttgccgttccttccagcttagccagcagggccttgagcagggttttgatatcgtcctcgccgtcgccggtcacatctccgcccatctccggctttttgtccggcaatggttgttgtggtgaaaggttaatgttgagattgacgccgcccggcagatcaccttcatcccccgttacagccgctggcgctgagtccagcagttcgttcatggtgtccgagtcacctgttttgatggccgtgcgcatgcgggtccaccagcttttcttttgatttgccattgtgtctctgtctccaattgcacaacgatttccggctctgcctttggggacaagagccacatggtttccggtaatatcgacctgctcagccttacccggctcagcctgttcatattccgcgtcatagccacacgacacttcgcgcagaccatcttcgataagctgaatggcgctttcgtctttgacgataaggtcagccagcatcaaatcagactgctcaccagtcccgcgccggacattctgaagatgaccgaccgcaagctctttccagttctcgggattgaccaaccggacgttcccgttttcatcctccggatgcaggatcgtgatgctcatcccttcgaaggaggcaagcgtggccggatggaatacctgctcaggagagcgcgttacgactatctcaccgaacttgtcaggcttgaggtttggcagatcagcagcgccgtaaagctgcttacccgttcgacctatcggcacgtctctacacagcagcgagccgtcagccagctgatagcgggtttcccccagccgggtattgaaaaaatatttcatgttttacctgcgattcaggcgagataagaatgagggttggggaagacgatttctttataacagcggcagttcgggagctcgccagcgtgaccggtcatgccgtcaagcgttgggggtcgtccccattcgacaaacttcccttccatctcccgatgagaatgccggacgtcgccatcttcggctgtacgccagatataaccattcgagccgattgacagcgctcgcgcctgatcgagcgcgccggttgcacgtccaagttcggtacgggcgataaggtcagccctggactttgctatatcacccgatgctgcaatttctttagcaaaatgctccgctctcccaccggtcacaacagcttcaatcgcccgattctggatgtcgtataccctgtcagcagcctcgaggggtagcgatttaatgtacttaacctgttcggcaacgatggatttcatcacctgccctggcggggcattgctcaccagattgcgtagttcacgactgatggttttgctgtgtttccgccactgctcatcattcttgcgcacaatgtcagcggtaaagttctcagcaaccttcgtcgcccacggcgttataatttcgctgtagcgctccagggcctccatgatttcggtgacgctatcgtttgaaccatcgtagtgcccatttacgatatccccgaccgcccgcgctatctgccgtaggctcgttcgatatcggatctccgcctgtcggctctggcggtttgtcgacaagttcgccgatgcctggtggcgcttcgtcttcggcattctcgatatcctcgtcggtaatggatgcgccgatgccagtaacatcggagttctcacgcaggtcggtcatagcggctttggttgtcatcagacctgcatccagcgcattgacaatcgccgttgtggtattcacagccaccgttgagcggtccacatctgacatctgccatagcgggttaaactcaaacgtgaaatcgtccggcagcggcttaccgagctccgaacgatgcataatgtccagcacccggcgcactggcaggcgtaagcgacgctcctgcaatgaactgacccggtcataatagttggcaaggtctgcgtcacccgttgagaaacctttaggggactgcccgaagaggcgcaccaatggaatgccaacagcaccgctaatctgctcggcgaactgcgaaagaatgtcatccagaccgctgaaactgtactggtgggtttcgaaggtatccttggcatccattagcgtcatgccttcattgctctgaaactggcggatcagatcaatgtttttcagcaacgcctcgaatgccgggccgcccagtgcaataagctcacggagtttttccactttgtaggtccgcagatgcgctttgtagaccagctgcgccgcaccgacagtggcgctgtcgaacgcagtaagccgatcccagatacgctctacaaccgacattccccattcgttctcggtcatcttctgctggaatggcagcgtcaccccatcgaagcgaatcaggcggctatggtgaatacgccaggcggggatgcccgttgcggtggtcaccacatcataaagctcgggcttgccgagatttggccccatctctttaatgcggcgcgtcagtaccgggttaatcatccagcggtcgagcgggagaatacccttaaacttgccttcaccaatggtttcgagccgtagcggggtcatgggcgcctgaccttctatcatgatgaagcccaccgcgccgccgtagagacgagaccatttcagtacgtcgttcagcgcatcccagatttgcaactgatccagttgcgcttcgagagtgccacggtcttttgcgtcaatctcagaagtgatgcgaatgcctttgcgggtcatgtcgtcggggatagcatctaccgcttcaccgatgagccaggatgagcgataggaccattccaccagcatacggttgcggctggtgaagttcgcccggtaggtcgatgcggagtgctggttaggcgtctgcatccccacgcgggtgacaaagttctcgtagccgtcggccgtggcctgcaccgttcgtcgcgaggcttgtttgtttcgtgccatcaggcctgtctccccaactgttcccagatgtccagcgatgtgtcggttggcgcgaaagccataatgaaagcgtcggcgacgtttggtgacggtatatcgcgttttgcgaggtcttttttactttcgaccatcacccgtccgttacggtcgaaatcgcgatgaggcgttgtcagttccagtttcagcttttcaagcaacggacaacgagaatctatgctgatcagctcatccacaagatactgttctccgttgttaatagcgttaaacgtatttctgaaacggtcagccaccagccaccacgcctgcgccttaagatttgcgaaaaagtctttgttggggatgccgttgtattcgtcatctggctcatgcacacctgcaccggcgttaaaccgctggtaattcacacgtcgcgcgtatgcgttctcacgcttccggtcatcgttaatttccgagaactttgcgcccgccgacgcgccaacaccgattgagtcgtaaacgatatctgcatcgcgctccattgcagcctggtaagtgcgctggcaactcttcagcaactcgtcctctttggccttccattcatcggcccagtagataactgagccataacggtagacgttggcgcacttatccgcgccactgtcggcgacatcgaaaccgatgcgcttacgtccttcaggaccgaaatccagaaccttatgcgcgtcaacagccgcttcaatccacgaaagcttaataattgccgcatcatcatcagactctggtacgccctcataaacatgcacaaacccttccgggtcacgacgccttgccgcatcgataaccttcagcatggtatctgaaaggaatggattctcgtcgtagttgattttgcgaatcagcgtatcttctggcggatcgaccacaaagttacgccacacgaaatcggtgaccagtccagggttaaaaataaaccaacactctgaaccctctttacggattgtcggctccagtattttccattgatattccgtcagtgcatgggcttcttccagccacaacacatcgatcccctccagtgacttaatttcttcgatgttgcgccataacccataaaaaacaaattccgagccggtaacccggttaatgattttgttgttcagaatgcggaaacgatgccgcaggccaaaccggtctatctgaattttgagaagcgtgtaaaccgattcttcaattttgttctggatctggcgagcgcagcaaaaacgcaggctgtatttatttgccaagaatattgcaaatccggctgcatcccatgattttgacgatgaccgcccgccatagagcactttatttcgcgcctgcgtggtccagaagtttctcagggccggattaagcgtcggtctggatatcggcgtagaagtcattcaggtcacgttctccgttaccatcatcaataccagcatcacgtcgcagcctgtcagcctcgagagataccttatcagtagccgccaaacgataatcagtgtcggcgtgtattttgctaacggtcgccagcgttccaacgatggattcaatgcgcacggtgttacgcatcatcgccttttcggcagcgctgatgttatccatcagaattttgcgctgctgctcttcctccgcatcctccagcagggtgaaccagcgaccaatgttctcggcggccatcaggttattcgcccgcagccgaaagagctcatcttcaagcgtcagcgctctggcatcctcaacaacttcatctttcagtagaaggcgccgggcgtaaccgccatgtttcagtgcatactgattaccaggctgaaaaggaggatgattagtgacaacctttttgcgtaccgcttcgggtttcgtatctgcgggaggtccggattctggccgcgaatgcttttgcactgcgccggagctggcaggcctcctcgtggtacgcaccgtgtttttttgcgtaccatttttgcgtacctgcgtaatatttttgcgtacccactccagcttctttgctttcttccttatcgccccttccgttacgccgtacagcgcccctatgtcgcgaaggctcataattccggcccggtatgccgtctcgatggcctcccagtccggttttgccatgttgctgtcctatggttaaagccattaaaaaagccacccgaaggtggcatttgtgatggcaataaaaaccgcccggaggcggcttgttatcaattacttaatagctgttcgatattagatgggatcgggacaccaggctctacttttagtttgtttagcctttcgacaatagacagtttctccgccccactcgctgcttggtagtagggtcttaccccttcaatgatatcattagctgtaactgaagaaccaacgccagcgcctggctcgtttttattcaaagagctgtgaataatttgctcaatagcctgattcatagttattacccaaaatgagtggttacataccacaacttgtatatatgtccaccacaggcctttatcaagcccacccgtagataggctttgtaatggctacttcactgtttcgatggtcgagccgtgagagttcatcacgtaaacctggtcgccaggatagatgaactggtaacggcagccatcacccgcgccggggaaattttcactcggatattcctcaataatgatggcaatagcatcagtatccagcacatcagtacggtcactaataaccagttcttcctcctgcagcgctttggtcatttctggatcttcatagatagccgggagccagtatgcgaagtccgggcaggctgagttatgagtaagttttaaagtatctgcgaacgtttcagaaccggccctggctatcgagatggatggctgctcacaaatatgcgtaacaccgttgatgatggttttaactgtaaacatagtatttccttcttcgtcttcttgttacaacaaaaagccccgctagtgcggagctatgggattgttggttgactctctcaccgagttgtaaatgcgctcacacgtcattcctgcgcggtagctttcgtcagatcgctcagcataatattgagcttcttctgcaaggcttccgaacatgtcggcgagcactgtggcgtcggctccggctgttttgcttctgacggcagcggcaagatttgcggtgtgctttgcggcgtccaggcgggtggcaagtttttttgcttcggtacgcagctggctaacagtggcagacaggccagcagcagtggcagcagatttagcggcttgcgcttgtgcatctttcacagcctcatcacgggcaataatgcggccctgttcaataatacgggcggcggtctgggcgttgacttcctgagaggattcagcgctgtcgcgatctgcccattttttttgccagcccctgtcactccagacattaccggcgataaacgcaccagccatcagcaaaataaacgccagctgcaaccagtatcttttcagaagagcagataacagattcataccagcaccgattttgctttctcaaagcgctctcgccgatcgccgaagccgttctgccctccgttgatgatctgcgtaacacgtaccaggtcgccggaatatttcagacaccctttagtcacaaaaaaccacgctgcggatcgggcggcatgacgttccagttcaagctgtcccggattcgccaccagatccagtttcagggcaacgccacatctggtgtaattctccagcccggtaatctggataagcccacgcccgcgatacttccagccatctccggcgtctttgttacccatgcggccaccgtaaaccagattggctatttgtggctggtgggcaacctggcgaccatcaatacgccccagcatttcgcactgatacggcgtcaggcgtttaccaaacgtcttcttcagcgcctccactgaataattgaagctttccttcagaacagtaaatcctgctgattcatgtcccgcttgtgcaataaacatggcctgatccagtggcgcagtgataccgaattcgctcattgccgccgtaatatacggataccagcgcgcagaaagcccggcgctaataccagccgcctgctgaaattgttgttgattcatcagtgcctcagagcatcaaccagacgcgccacattaccgcgagcccacagcacagcggcgcagataaggatattcaccatcaccaccagccagtgggatgattcatataaaccaaaaacaaaccggaaagggacactggcatacaccagcaccatgacataggccagtaacgaaatcagggggcggtgtgtcgcatcaccgcgtcggtaaaacatcagaacgatgactattaccccacaaattacggcattcagaactgcagaagggtcatttgctaccatctgatccccctcccctgatacgagagagaatactgaacagagtgttcagatcctgactgttgagaaaagtgagaaactttatacacattgcagaaataattactgcgccaagtgcatccagtggtttttcataatgcgttattgccgcaagcttagtacctatcagcccggcgccaagcactcccacaataaatgacgtgataaaataagcgaccagcctgatgcgtccgatgttggttgccgtggcgacataaaataccgagccggcaaaagcgccgaataccacaccataatcggttccggttgccagaccgaatacactggcccccattaatccaccagccaacactgtcgcactggatacaggttcggacattcatccccctctggttgtgtgggtcctctcagttatgaggggaaataataaatatcctccggcatagccggaggatatttattcataaagaacacaattaagaataataccgatttaattaaaataacttgatctcacagttgaagaatgaataatagcgagccctgccaaggcagggcatagaaataaccaacgagaagaaataggtaggaactaatgaaaaacaccgctctgggtaagttcatttttatcgtcggcaccgcgttactgctcggtggctgtagtggcatggtcatgcctccctatgccacccacggtacatcggtcggaatcattgcgccggcgggaggctatagcgagtggcacacggatagccgcaaccacaccacaggagacagtcacagccagtcacagggaaactgcacccaaagtgaagatagccagctcagcgaaaatggtctcacacggacacaccaaagcaactgtaacacccgtagtcaaacccacagcagtagcaccagcaaaacccgctccagcagcgtcggtttcagcgtcggggggcctgttggtgctagcatagggttgatcaagcagatggagtcgatgaaccgtgcgccagccaacgatatgagtagtaatgagatgttcaagaatttcggtttctagcacataacgccacctggtaccgttgtggtgtctggcccggcggctatctgtaacgactcacaatcgaaaaaagtcagactcgcaatcagcgcaaattttggctcacaataactgcaactgaaatcggacgtggactcacgctaagtgagagcgaaatccgacgctcagagccaaatgagaagttttttccattggcagtaattgtgagccagcaaaaatagattgtgagtccattgaatggggatcgttgtgcattttcataagcctcacctccgatagctcggatggcgcagtgtgaagtaggaaggccgcccggtggatcaacgacaaagctcagagggattattccggacggcacaaacagaaaagccccggcaatcaccgaggcttaaattgttgccggttaccgctccggcgcgatcagcaaaagctatcgcggtatcagattgtggtcctgcccgtgtgagctttgcggtcggctggaacatgtagactccgcatcactccccgcactttgtcttattggcgtcgggaatccataaaagaaaaccccgccgaggcgaggttcttaattcttgtaacgtcacaggcgtaataacccatcgttggaatcaggttagccattttccgttaattttgcaatagctaaattattttggtcatcgagtcacgtttcccagaaccttttctgcatacgactcctcaatatggcaatgctccaccagtcgatcgaaaaacagtttatagttgtaccgccataccatttccgttactcctagtgctttaaaaatctcggtatctttgagacgtgggtagcctcttcccttgcatcttgggcattttttataaaccggcacgccctgcaactcagattttttcttatcgagaatttctccgcgtccccggcaacgacattcatttttcacctggcctttgccatcacacgccttacacactacgcgcacctgctcacgaactgatttccacacctcccagtcggacggagaaatacctttcgtatcttttacccattttggtggcttaccatccgggtaagtaaccttgttcgtgaaaacctcagcatcaattaatttagcaccatgacagctactgcacgtcaccaagctggccgcactgagggaataatcgcgaaatacataacgcgccatagtgtcgagaaattttgagcgcttacccttttccattttccgtaatgccccatgccgttctgcacgctgctctgctaattgcctgatgtaggcgatgatattttcagaagataaaaccccggcttttgccagatacaattcaatacccactgcggcttttgcagtaagtagcccgagagatgccattacgtcagtaatagtcagcgtatcagacgttattccgcatggtactgcgccgggcatcatggatttaggtgaaaaatatttcggtaaggactcaagattcatttcgatgctcccgttttgcttcaatgcggacgtaattacgaagaatgcggtatgccacaggaaaagatccccggtatcgataaattcggagacgcaaccagcgcatgcggagtatctcgatcagttctggtttcatgcggcctccagcttttttagcgcacgcagatccgacagtgccgcgagcctgatttccttcagctcctcgaccgtccagcggtgcggggtgttattgttctcgagtgccagcaccgccgcctcaccgtaacgctcaaccagcgcggcacgatatgcttcgatgttccctgatttgtagacgttgcagacatcacactgaagatggatgttgaagcgagtgaagcgcagatgcccggcggcggccgtactcctgtaatggcctgcatgccatgcgaatgccgtcttcgttccacaggagatgcaaccgagtccttctgccagttcggtttcgcggcaaatgtcatttacggcgcgctgcgtcaagtcaatccagtgtttcagcggcttaaccgcggctttccgctggcgccaggcggcgcgttcttttttctcagcggcgcgctgaagggattgcgccttacgttgcgcggcttcgcgagcttttctggtctgttctttgccgacggtgctggcgcactggtacgagcaaacgatctgcccctctcgtatcgggtgaaaccactggcggcattctttgtttgcgcacttacggcgcggtaatttagccatgttcacccccagaccttttggcgtaaggattttggcgtccgcacccggtgtgcatattctggtaatttcgcgctgacagtccaggtaatgaagtcagggttcaggctcttttctgtccttacgccccgcttctgataatccgatatcagcgtgtcggcctgctcggttgtgcagtcgtgatgatggaaccaggagtatttcatcgccatcaccccgcaaagctcatgagctgggcggcggcgttctccgcctcgcgctgagtacgaaatgtacgtgataaaatccaccgccagagcacatcaagcgcggatttatacaactgctgaaattcgacctcatccatgctggaaaaagcgatgctgcggggatgtttgcgaagggtgccgtccggtaactggatggcgtcatagtgaccagcctcaaccgtcacccatgcgcggtatgcatcgaaagatttacagaggctaattccgtttgttacccggcggtttgcaatctgttccagatactgttcagccgcatccagtaatgcgctttcattcccgccatatgcagcgagaaactttgcataaccgtttaccagtttgcgctcattggcagaaatggcgccgccggtgggttcccagtattcaaacccaagattaagcaacgcgaaaaagcggcgatggaatgcaggattcctcacctgacggaactcagccaccagcacggcgccgagtttgatttttgattgcagaatatcactggtctccggcgttgcggggatcagaattccagatgactgcttgatgagttgtaattcgtgcgccatggcgttctccgtggcgcagcaggtgcaggttgttcaggcctacatttgaagtgtatcaaagcaacgggtaattcgatagcctgccttttctaacatttgcgtaaataatgttggagttccaactatgtcatcagggtgaaggggaacaaaagatatctcgtcaccacgacgatacatcagggcgcgtccgctatccggaatactaccgaaccttgccactacacaatgatcgtaacaacgtataaccgcataccctgattctggtaagtcttctaacatgtaaccccccgtcacactgactttatttctggaaacgtctgcgactccacgatgcttaatatgcataaaaccagtcgtcagcgctttcccacgtttcctgcagaatgctctgtatacgttttttatcgccatcagcagcaccgacgatactcagaccatcctgactgcctcgacggatggttaagttgcagttttcatactgattctggagacgggtaattaattctttttcaagtgcaggcacggcaccttccggaagctgttttgtccggctgataacaagttcaattctcataattccctctacatttaactactgtatataaacacagtatacctgttagaaagaatattcaagaggtgaatagcactttttgcaaaagccatgccattgtataggaagagtttttcctagtattcggaatttactaaatcagttaggcaaaggctgaaagcgaaaaaaaacccgccgtagcgggttattcattcgatttgattcggatgtaacgtgaggtcgccacgagagcctgaatcatattaccgccagtttcgcataacgttctggaatcatactcgcgtgaccagtggcataaccaattttccaggtcatccactgcgtaatctttacgagccaaaccctctgcgatggttacaacttcatcactaggtgctgtaagctcatatccgttcagcaacaggaatacgtaacctgccatcatagcggtgcgtttgtttgcgtttgcgaatggatgattctggattaggctttcaattagaacagcagacagacgaaacatatcgtctgtctgctcataatatcgaatggtgcttggccgggactgggaagaactgaggttgttcggattcagtacgcctatcggttcatttggcgtctgaatctcgatcagagacctgttgatgtaaacgatatcttcaatggaaagataattgactccttcaacatactctatcgccatccgtttttactcagacctttgaaagttcttccatcgccttctcgtaacgagcaaacccaaactcaaaggcgtttttaacttgaccagtatgtgaacatgctttgctgatcgctgcacgaggtttcgccaccatggatttgtcacgaggcggaatgtacaagcgatctgccttttttaatgcgtgacccatgattatcaccctcatgcacgtttggcagtgctttctcaaattgtaggatgtaaacacatccaaagaatttatgatcactttaagtggttgaggacaatttaataccattcgtcatatttgagcaatgggcctgcgtctgaagatagaagcatgttcgacgaaaatctcaatggccactttgcaagttaacgacattttcgcagaagttacccctcaggtaatagtaaactattgtcacgatctcaggagataggctggtcctgtgagtcgattaaagtggacacaaagccaataaatagcactttttgcacaaaaatcatatcctggttggaatgcacaacgcccaacattgctgtagtatttcgccccctctgaatgtagcgctcagattttaatcgacccaatcccgccctgcttcaacatcaagccccgcatatgcgaggcttgttgggctaacccgccgcagcgggttatgacgcaacacttcatgccggagttttccgatccgtcttgttgtgaacctcccagagactaatgccgcaactgaacacaaactcagccagataatttaaaccggaccattcccggatgccgccgcgcgccgcttccacaaatacagcgatatcctgatcacgccacactccaaacaggcgccagccgccactgtcagtcttaacggctgctatacgcgtcagaacaccagtctggtacaggtcagtgaacgcaggtttcttcctggttattattcgcatatctacaaacctaagaaatgttgattacaaatcactgattcgtattttttgattttgcactaatgccgatcacaggaccggcatataggtgtttcacgatttacctccgttgagcatggcagcgcgacaagcgttccagatttcttacgcatcgtcgtcgttgaaaagcgcatcagaatgtgaagccatcaggtcgcgtatttcttccggacattcttccggcactaccggcactggctgctctttgatatgcagtcgtggctcgccgtctttcggttcaggccattcgcgcttcttgttcaccgccagcttttccaccatcgccagggcaatctgctcgtcagtaataccagcgcggcgttgtgcatcccataacaggaattgcatatcagcccattcgctcaggtcgccaagttctgcggcagtttccaatgcttcttttgagaggtgcttcagtggaccgatggggccaacatcgccgaatgtggcatcagaccagtcagcatgttcatggcgaacttgttctcgttccagcgatgccagcgcacgcttcagcacaataagaattttggcgtcgtcatcgctcaggccaaacggaatatcatcgcgagtgttttcaaattcagcgatggtttgctgtagccattctttggtaatagtggtcatgggttagtccttcacaaaaataatccagtgggttttatcgttcttgccggtgcgctggccaataattggtttcacgtcagtaagcgccaaaatctggctaaccggaatctgcgtttcgttccatttgaaaatgagaacgccgtgtgccctcagcacccgaaacgcctctttgaatccggcgcggaggtcagaacgccatgtttttttgttgagtctcccgtactttttgcccatccaggccgtttggccgacacgttccaggtgaggcggatcaaacaccacgaccggaaacgacgcatcagcgaacggtagcgcacgaaaatcagcaatgaggtcaggactgatgactaggcggcgaccgtcgcacaatatatgctcctcggcgcggatatcggcgaatacggcgcgttcatcgcgcttattaaaccaaaacatgcgcgagccgcagcacatatccagaatagattgcgattccatcacgactccttaaccttgatgccagcggtgcgtatttcgtgtatcgcattatcattaccagcacaccaaccctcggcataatcccggctgaatccggtcatgtgcatgacttctccaacgctgagttttgacaggttgaccttccgcgcctccagttctgccacccggcgagcctcacgggttgcaattcccgcgtattcaatcaggcgttggtccagttcggctatgaggcgttctgctgtatccaaatcctcgcctaacttctgcgccatccgaaaccaattggcgcgctgttcctctttggtttccagctcatccagcagcgccagcatggtggcggggttggctgcggcgataaattccgcgtcacgtttctcaacagtatgggccaacgtcacttcttcaccgcaaagagaaaatggcgttaccgtgatgccattgaacagtgatgaggtgcggcgccaattccccggcgtagccctctcagccacttcacgaagcgcccgtttgtcgatgttgctcattgggctccccccttgttgatgctcattttggatgctccataaacctgcattaccgggcttttctccagcaccggcagcgctgaaaatcccgttacctgactactgctgtatcgcctgaggtcataatcaatcaccgcacgctggtctcggaaaatgccgcagcggccatgacgaatgaagccgcctcgctccagcgcgatacgcagatatttctccgccgtggttcggtgcacgccaaaaatcgcaacgacgtcgttcgtcgtgatgcgcccctgctctttcaccagaccgataatccgctcaagaataatcatccgttcgctgtgtgttttaggtcgggccatttttaaccccttatttcacaatccggaggtggctaacgtttttccggtagctttcccagtcaaaattcacccacatccctccgtccatctggaggcgatcgataaccctcgcgcccagtgaatccaacagcccctcgtggttaagattcgtcagaacgccaacaggtcgcatcgatgagagacggcgatcgataacctgattgagaatgaccttctcaccactgctcccgcgctgaataccgacttcatccagtaccagcaggtcaactttgcaaaggtcatcaagcagggacgcttctgattgcccaccgtcgtagcactcacgaaccctgagcatcaggtcaggaatggttaccaccagaacgctatgaccgccggccagcagatgatttccgattgccgccgcaagatggtttttcccggttcccggaccaccgctgaacacaaagctcgcaaatccactaccgaagttctgggcataactttttgccatcgtgtacgcttttcgctgcccctccccgcttacttcgtagttagcaaacgtacagctacgatggagatcctgaatgccagatcgcccgaaaatcttctcggtgcgggatttctgattcatcctgtcaagctcttcactgcgtttacgcccttcggcttcctgccatgcccgccactcatcagcagtcgagaatttcggctgcacactggctgggataattcttttcaggcgatcaagcgcactgccagtaccgattacgtttttcatcgttaccccctgaatccggtaggaatggttttgtctggcgcagaaatgtggttcacatctctgccagctcttcggtcgttgagagcgaacttcggtttgaatagtccctggtagccgttggcaatgcttgtgttgatgacgtttaccggatcgtggccttcatccaggcactccttcagaagcctgaaagcttttgttaccgtcagttcggtttttatgggctttccggattgctggcggtatgtgacccattcgttccacgacgcagcattcagccattcgggaacaggaatactcaacggatcaaacttcacttttcccttagggggattaaagggggttagatcttttatatttgtctttggaataatgtctttggtgttccctgttttcggggatgcccttccctcttttcggggataactatccccgttttcagggatggctgaatggggtaaaacgctatccctgttttcagggataactatccccgttttcggggatgcccttcccccttttcgggtataactatccctggtttcgggtacagaaataatccatgtggcaatttcatcatcaggaaaagacaccggacattttgagcaatgtggcttggaataagcccatttatccaggtttgtattaatccctatgtatcttgtttgaccaatacggcgcaggataatgatgttacgataggcaagactcagcaccgcttcggatacatgctttaccttcagtgttgtcttatctgcaatgaggctgttggcaatacgatctgattttttcgaccagccataagtcagccggataatcgcattcaaaacacggaactcacgccccgatagttcaacgatacacaaggcgtcctggatctgattagctaaacgtaaatagccattttccagatcagccatacggcactcctgttgcgtcggtatcggcgcagggaatttgtatatttcagcggtatttgacatactcatctccgcaattacctaccgtttttgcaccagaaagccgttggtgacccctcaccgcggctttcgcctttttggttgctgtcattttcagtcccaccccagcgcatccggcctggctcgttcagcctttagcccggcatcagcgagaatctctacggctgtgagatagtttctggataccagtaccgcttccggtggcgcggcctgaatcccaagaaaagccagctctttcgccatgttgcagaaatatccctcagctttacgcctgctgactgtcgactcgctgatgcccatatgctcggcgtatgatttctgccctactgatgcaagccggttgagcaggacactctctatctcaatcgggttgatttctggtgggtctaactttcgtgcaattgcgttctccatgggtaaatatcctctatggttatttggctgatgcctcttggcttggtaagccatcggttgggtttgggtagagatcaggacgcagttcgtgtggggtgactttccagtcaatagctcttgccactcgaactacaagttcgccgggaactttgtttttaaaccagccgttaacggtctgagcacggcgaccaagtcggcgtcccaacccagcctggctacacacggaaaggatcttgcgttgaacagttactttcattggtcggtctcattgagtgaagatacaaccaattattcaaatttaatcgatactgtcaaattatttcgatagacatacctacagaaaaaatctgtataatgaaaccatgtaattgtgcgagaacgaaaaatgaactttggagagcgtttacaaagagtgcttaatgagactgggatcacccaatctgagttaggtcgtagagtcggcgctacctctcaatcagttaatggttggtgtcagtccggcattcttccccgaaaagatatcttagagttgttacctaaggccacgggtaagccgttgtattggttcttcatggaggatgatgatgaatcggatgtgcctgaacgtctaacacaaggtggtccaacagatctcaatgaccgacaaaagcggctcttagaaatatttgatcagctaccgactgttgaacaagaccgttttattgagctggcaggcaccagacttcaagaactagacgatttcatggctgaataccaaagacgcagaaaaatcgagcctccttctcgctaaaccagctttaaaactactaaccgccttaactggcggtttttttatgtcattaattcacccacatctcgctttcttaatcttccctgtaaaattaatcatcaaatttaattgacatgtatcgattgaatcgataatacttaacctatcaaccgcagcaacgagtcatcaaggcaggacgcccacgaagtagccgcccggggcatacgaagaccgggatgagatggcaaggttaacgcgcagcaggtgataaacgttccgctggccggcgataaggcaaacgagggtgagatgactaattacggcacaacaacattaccaagaaccagcgttgtaccgggaatgctggttaagtaccaggggcgcacataccgcgcatctgcaaacgtaggaaaagggttgtacttgtttacccttttcgaacgcctgcggacaaccaacgacgagatcgaggtttacctcaaccaacacggcaaacctgcaacccattagcaggaaaaaccagcaaaacgaaatactgcacagattctggcagaccacatggtgtcggggattctgcaaaccaaattcaggagttcagccatgaacgcatatctcacttacgaccggatcgaggctcaggactggacccggcattaccagcaaatcgccagagaagagaaagagtcagaacttgctgacgatctggagaaaggactgtcgcttcacatgctggagtcgctgtgtatggacgagctaccacgccacggcgccaacaaaaaagcgatcagccgggcatttgatgacgatgtcgaattccaggagcgcgcgtcggagtttgtgcggtacatggccgagacgttttcccggcatcaaattgatattgaatcagaggaataagacaaatgagcacagcactcgcaacactggcaggaaaactggctgaacgtgtaggaatggattctgtagatccgcaggaactgatcactacattgcgccagacagcgtttaaaggtgatgccagtgatgcgcagtttattgcgttactgatagtcgccaaccagtacggtcttaatccgtggacgaaagaaatttacgcctttcctgataagcagaacgggatcgtccctgtggtgggcgttgatggctggtcccgtatcatcaacgaaaaccagcagtttgacggtatggattttgagcaggataacgaatcatgtacatgcaggatttaccgtaaggaccgtaaccatccgatctgcgttaccgaatggatggatgaatgtcgccgggaaccattcaaaacccgtgatggtcgtgagattactggaccgtggcagtcacatcccaaacggatgttgcgacacaaagcaatgatccagtgcgcccgtcttgccttcggtttcgcaggtatctacgacaaggatgaggccgaacgcattgtcgaaaataccacgtataccacagatcgccagccggaacgcgacatcactccggttagcgatgaaaccatgcgggaaattaatgatctgctgatcaccctgaataaaacatgggatgacgatctgctgccgctctgctcccaaatcttccgtcgcgatattggtgcatcgtcagatcttacgcaaatcgaagcagtgaaagccctcggattcctgaagcagaaagcagcagaacagaaggtggaagcatgacaccagaaattatcctggctcgtacaggtattgacgttagcaacatcgagcaaggtgatgacgcgtggcaccgtctacgcctcggtgtcatcactgcttccgaagttcacaacgtcatttccaggccaaagtcgggcaagaagtggactgatatgaagatgtcctactttctcacccttcttgccgaagtttgcaccggcgtggcaccggaagttaacgccagggcgctggcctgggggaaacagtatgaagatgatgcccgcaccctgtttgagttcaccactgacgtgaaagtcaccgggtcgccgatccttttccgtgacgaggacatgcgtaccgcctgttctcctgacggcctgtgcagtgatggccgcggtcttgagttgaaatgccctttcacctctcgcgactttatgaaattcaggcttggcggcttcgaggctatcaaatccgcctatatggcccaggtgcaattcagcatgtgggtaaccgggatagatgcctggtatttcgcgaattatgacccgcgcatgaagcgagaaggcattcaccacgtggttgttgagcgcgacgacaaatacatgtccctcttcaatgaaatggtaccggaatttatcgaaaagatggacgaagcgctaaaggagattggcttcacgttcggggagcagtggcgatgacgcacgcacaggacgaaatcagggttggcgcgatgcgccatcccatgttgaagaattaaatgttagaggacggaagtatgagcaaaattggtgactatttctttgaattcccggcatcaagaggcttacagggaaatacggttgtgttgatgatgacagtcccagcgcgcgcgctaactcgcgttctggcatcagataaccacggcaatacgcttgagcgttctcagcgagaactcaatccagcgcgtgcgaagaagttttatgaatacctgcgaacagcttacgagaaaaaagagccgttcatcatcccgccgctggttggaaactgcgactcattcattgagttcgaagagtttggcaatacgaatgtgggtgtcgcgcgattcccaatggatgcggaaattaaactgtttgacggtcagcatcgcgccgcaggcattgcagagttctgccgcacttacggagagcctattcacatcccaatgatgctgacacaccaactgccgctcaaaacgcgccagcagttcttttccgacatcaacaacaacgtatcgaagccatcagcggccatcaatatggcctataacggtagggataaaattgctcaggatatggtttcgtttttgtcatcccatgccatgttctcagaaataacagactttgaacacaacgtggttccggcgaaaagcgatctctggattagcttcaaacccctgagtgatgcaactgcaaaattctctggtaatggggatgagcttgctactagtgacatctatgacatttgggaggcatggctcaagctaacagccatcaagggaattaggcatggttgtacgcctgttgaatataagcgggattacatccagttccacgcggtgatgatcaatgcgtttggctacgcaatgcaggaactactacggcatcgccctgcacacatcattgttcagatgattgaggagttagtaaataattccactatgagtgagctggagaatttcttcctcatttcatcctggtccggtgtctgcgccagcactgaaaaagatagagcgacagttattgccagcgttgcttcacaaaaagctgcttcggtgagactaatccaagctattacgacaaagagctttgaggtcgcagcatgagatacggctctgtttgcagtggaactgcggcgatgcccatagaggaaccggcgctgcgcacctggcgccgcccgttcctgaaatgggcaggcggtaaatattcgctgctgccggaactggatcgtcttatcccggcaggtaaacgactgatagagccatttgtgggcggcggatcggtgtttcttaactcagacaagcacgaacgcttccttctggctgacgtcaacgctgacctgattaacctgtaccagatgctggccgtagtgcctgattcggtaatcgcagaggctatgaaagctttcagacatctgaatgatgccgaaaactacacagtaattcgtgaagcattcaacgcccagaaactgaatgcgacagaacgagcggccgcattcctttacctcaacaggcactgctttaacggtctgatgcgttacaaccttgacggttttttcaatgttggatggggaaagtataaagccccatatttcccggaagaagagatcagggcattcaggcagaagtctcacgcgtgcgtatttatgactgcgggtttcgaacgtactctcaggctggcgggtgatggtgatgtcgtttactgcgatccgccatacgagccaatgcccggcaccgctggcttcactaactacgcctccggtgggttctcatgggatagccaggtagcgcttgctgaaagctgtgtggcagcccatcagcgtggcgcaaaggtgtttatcagtaattctaccgcaccacgcgttattgaactttacgagaggcacggcttcactctgcaccgggtcaatgcccgcagatcaatatcgagtaaaggcagtacccgagaaacagcgaacgatatcgtcgcctcactggggatttagtgatgatgaaacttattaacagaagtaagcaatcaccagtcggtcgtcgcgcatgtgatattgcactggctgcgcatcatgagaagttcggcgattacggcagacaaaagcacgttaccaattacaccgttgtagtggatggcgtaaaggttcctgtcgaagtagttaaccgggccaccagctacgtagccaccgcaatgatcggcgtccggaaacttagaaatctgccagcacaggcaaactgaatattagcgatggcccgctgcggggccactggagaaaacgatgagcaacattatccaactgacgccaaacaagtgggttagcgaaaaagttctgattgcggttaccgggcttaagcccggaaccattacccgcgccagaaaagaatcctggatgctgggccgcgagtacctgcacatttcaccagacggaaatccgaagccttcgagcgaatgcatatacaacagagaagccgttgatcagtggatcgaggcgcagaaaaaaaatcaaccaggtgcgaagacaacatgaaaagcagtacactcgtcaatgctcctggacgtcaggagggattaatggctaatgcatcatacccgacaggcgtcgaaaaccacggcggttcgctccgcatctggtttctgtataaaggtaaacgtgtcagggaaaaccttggtatccctgacactgcaaaaaatcgcaagatagctggcgaactgcgttcttcggtttgttttgcgataaggatggggaattttaactatgtggaaaaattcccaaactcaacgaaccttgcccggttcggtcaggatagaaaggaaattactgtgctggagcttaccgaaagatggtccgagctgaagagaatggagatcagctctaataccatgagtaggtacgaatctatcataaaaaacatgcttccactcatcggcgaaaacaaaatggtttctgcggtgactactgaggatttgctgtatgtcaggaaggagttgctgacgggctttcaggtaatgaagaaggatcaccggactcaggttaaaggccggaaatcgtccacagtgaataattacatgatgctgatggccgagatcttccagtttggaacagataacggctatgcaaaggaaaacccgtttagcggaattaaccgtctcaagaaagcgaaaggggaaccagatccactcacgacagacgagttcatcaggtttatccaggcatgcggccaccagcagatgagaaatctctggtcactggcagtctataccggaatgaggcatggggagttgtgcggtctggcctgggaagatatcgatctgcatgccgggacgatcattgtgaagcgcaaccttacccagacggatgagttcaccctgccaaaaaccgacgcaggtactgacagggtgatatatctcattcaaccagctattgatgccctgaggaatcaggcccagttgacacgccttggccggcagtttgaggttgaagtgaagttgcgggaatatggacaatctgtcattcagccctgcacgttcgtattcagccctcaatgcgtcaaacgtggacctcgcacaggatatcactacgcggttaattccattaataaaatttgggccccgataatcaagcgtgccggcattcgttaccgtaacgcgtatcagtcacgacatacctatgcatgctggtcattatcagctggtgctaacccaaactttatagcaacgcagatggggcataccgatgcacagatggtttacaaggtgtatggaaagtggatgtcagagaagagcgcagaacaggtttctctgctcaaccaggcactttcccgctatgccccatcactgccccaaagcatggtagcagcgcagtagaaatccttaaattcaaggggttagcagtcgcatcgctacatttttataacatggggcacgaaatgcgctcgaccctaaagacagcttatggtgtgatcggggttcaataaatcgctaaacaaggtatactccagcggttttcttagttgtttattgtactaaacactcccgtgagaggacgcaacagcgcacctatgacacaattcgcttctcctgttctgcactcgttgctggatacagatgcttataagttgcatatgcagcaagccgtttttcaccactactatgatgtgcaggtagcggctgagtttcgttgccgtggcgacgacctgctgggtatttatgccgatgctattcgcgagcaggtggacgcgatgcagcacctgcgcctccaggaggacgagttccagtggctctccggcctgcccttttttaaaccggattatctgaactggttacgcgagtttcgctataacccagctcaagtctgtgtcaccaacgataacggcaagctgaatattcgcttaaccggctcgtggcgtgaagtcattatgtgggaagtgccgctgctggccgtgatcagtgagctggttcatcactaccgctcgccaaacgcgggcgttgatcaggcgctcgacgcgctggaaagtaagctggttgatttcactgcgttaaccgccaatctcgatatgtcccgcttccacctgatggacttcggcacccgccgccgtttctctcgtgaagtgcagcaggcgatagttaaacgtctccagcaggagtcatggttcgtcggcaccagcaactatgatctcgcgcgtcgcctggcgctgacgccgatgggcactcaggcgcacgaatggttccaggcgcatcaacaaatcaatccggacctggcgaccagtcagcgtgccgcgttggccgcctggcttaacgaatatccggaccagcttggtatcgcattgacagattgcattacaatggatgcgtttttacgcgatttcggcattgaattcgccagccgttatcaggggttacgccacgactcaggagaccctgtcgcatggggcgaaaaggcgattgcccattatgaaaagctggggattgatccgctgacaaaaacgctggtcttttcagataaccttgatctgccaaaggcggtcgagctctatcgccatttcgcctctcgcgtgcagttaagcttcggcatcggtacccgactgacctgcgatatccctcaggtaaaaccgctcaatatcgtgattaagctcgtggaatgtaacggaaagccggtggctaaactttccgacagccccggtaaaacgatctgtcatgataaagcgtttgtgcgcgcgctgcgtaaagcgttcgatctcccgcaggtgcgtaaagcaagttaaccatgcctgtgcgaagcgcccggaaagtgggcgctttgttactcttctgaccatcttacctgttctggccgcgatggtgactattcttccccttcactcttcgacatatttacgtgcgtgatttgcgttgttttttcagaattagtgtcccgctgtgtacgcgttctgaataaattgaattcgctaataaattctttacgcagcaagaacagagcaattacgttggggataaccagaaaaccgacagcaatatcagccattaaccagattaccgggatttccatattaacggcaatcagtggcggcaaaaaatatagccatttaatgatgcgttctagcttatcgccaaagatatagtttattgaagtgcgaaatttaatatatgaaccaagataagaagtaaacagaatcaacgccacaccgagacagagaacctgaacaataatcggatgccatgtttcttttaaggcggcaaagataatctgaataccttgataactggcgtctgtccacataccagaagcaagtacagcaaatgcggtaaagttacaggtaatcattgaaacaaaaaatacttccactgccccccacattccctgacggaaagcataatccacgttggcagtagcatgtactgtggccgaggtacccatgccggcttcgttagtgaatattccgcgactggctcctttactgatggccatcatgatggttgacccgacaaagccaccggctgctggcgcaggggcaaaggcataatagaaaatactttttataacctgtgggatagcctcgatattcaataccactacaccagcggcaccaatgaaataggcaatggtgatcggtggaagtgcaatcgtacagaatttaccaagactggcgagtccttttaaaataaccaacgcgcctacgatgacaataaatcccccaatgacgcttgttgggatgtcaaacgtatagtgaatgaccgccgccatcgtattagtttgcacaaaacaggcatccgtaataaccagaatcattaatgcaaacgcatataatcctgccaggggataccattttttattgagctctttcttaatataatgcattgggccgccataatattcgccattctcacctttacttcggtatttcaccgccagcgtcacttcaaccattttggtcatcatacccacgaccgcaatgatccacatccagaaaattgccccaggtccgccaaccgcaatagccgcagcaacacctgcgatcgttcccgcgcctaatgagccggatagcacagtggcagccacctctattgattttaaggattttttagacgctgcctcgccagtagtgttttgtttattttttccggcaagtgtaccaattgtattacggtaaatttcttttaaattgataatctggaaaaatttgaggcgtactgtaaaataaaagccaatgccgatgacacacaaaaataatgggccaccccatagaaattcaaagagttgtgaaagttgctctaacataatgacctcggatttaaattaattcgttcagtctcagaaataatctttccagttcagcgtaatcctgaattttgccaacaacactaaactggaaagtcagcgggtaggagcatcccttactcactaaatgccgttttaatggtatattgttatgaagttttgcttcctgcattaggtttattatgcgtataaaaaacgcgttttttacatgctgcctttattatctaattttttagtcgtaatgtttaagcactgcgtccgttccagactatatcttcataaatatctggggacgtatcgccttcggtgctaataagcagaacatgagcattggcatcaagctgtaagcgattagcaagatcctgataatgcatattgttcatcaactcataaagtaaccctacgccaatagctccggactcgccggaaataaaaggcgtatcagtgcctggacgcggcgcggcagcaatgcgcatacccttagccgccagacaatcatcagcggaaataaaacaactggtgttgtcccgaataataggccaactgataatattcggctccccacacgcaagcccggccattatcgtcgccatatcgccagtgacgcagtgaggttgaccatcattcataactgcggattgataaagacagttggcctgatgcggctcaaccacaataatattaggggtattttcctgcattttttcaacaaaataacccataacactgccagcaaatgatcccaccccccgcttgtaaaataaggtgggttggcaacggactgtttgtttctgcgagctgctcataagcttcaaccgctagtatcatatagccttgcataatccatgttgggatctcttcataccctgtccaggctgtatcctgcaaaagcacccagccttttgtttgcgccattctatgggccagtcgcactgcatcatcgtagttcagatcggtgatggtgcattcagctccatgatggcgaatattctctgcccagattaacgatgatcccttaggcatataaacgacggcttttagacctaattgctccgccgcccacgccacaccacggccatgattgccatccgtcgcggtaacaaaaacacaatctttaattttttctttaatctcaggagtgttaagggcagcaaaacttaacgagttaatatcacattgcaatttatcagcgagatattttcctacagcataagagccgcccagacctttaaaagcattcagaccaaaacgccaggactcatctttaatatggatggaccctagtccaagccgccggcttagatgcgccagattatgtaacggcgtaacggcataattgggtaattttttatgaaatgctaacacctcacgcccaacatttccgttaagcaaacttaaagccgctcctgtaccatattttttccgacgtgtattaaactggtatttaataagctcatgcataatgataccttttgttaaagtttatttattgaaataatatgtttttggcaattattgagtagaaacaagtaaagaactcgcgttttgtggctgtagtagtggttatcctcactttaataaaccgtactgataaaagagtcgcacaatatctattacgtccttttctttattccgctgattatgatagtactatgcttattgctgttaaatggcgcgaaaatgcccatcgtcgtgcaattttcacctttttttaacggcctggacgcggcaaaattgcgcacagtgatagtcatcacattaaagaggttatttgcgatatgaagcttgacgcctgggataaaaacattctgacattattgcaacgcgataatcgtctttctcagcgggaaatcgccgaacaggtcaatctttcaccttcggcagtgaatcgtcgtatcgcggcactggaggaggcgggcataattaaaggcaatgtcagccttgttgatgctggcaaagtgggacgcccggtcacgattgtggtgcaggtggtgatcgaaaacgagcgattcaatttactggaagaggctcgtcaacggtttgtcagttgcccgcaggtgcagcaggtctactacgtaacgggcgatttcgactttttactggtgctcaatgttcgtgacatggcggaatatgaaacacttacccgtgagcttttcttttcctcaggcaatattaagtcttttaaaacgattgtcgtgatgcaaaacgccaagcaagagatgcgcgtcctgatcgagtaacgtgcgcaaagcttacaaaaccagcctaaattctcaattgttcgcgagcaggtgcgaactttttacaggtttctttctgaaaacctgcttccagatgcgatttctgcttgtctgattgcagatgccaggtaacataggaatacccccatttcgggtggacaagtgtttattttttccgactattaactagagagaatattatgagcgttgtgcctgtagccgacgtactccagggccgcgtagccgttgaccaagaagtcaccgtgcgcggatgggtgcgtacccgccgagattcaaaagctggcatctccttcctcgccgtttatgacggctcctgctttgatcctgtacaggctgtcattaataattctctgcccaattataatgaagaagtattacacctgacgacaggctgctccgtggtagtaacaggtaaggttgtcgcgtcgccgggacaggggcaaagtttcgaaatccaggccacgaaagtagaggtcgcaggctgggtggaagatccggatacctacccgatggcggcaaaacgccatagcattgagtatctgcgtgaagtcgcgcatctgcgcccgcgcaccaacctgattggcgcggtagcgcgcgtccgccatactctggcgcaggcgctgcatcgcttcttcgatgagcagggtttcttttgggtctctaccccgctgattaccgcttccgataccgaaggcgctggcgaaatgttccgcgtctcaacgttggatctggaaaacctgccgcgtaacgaccagggcagagtagattttgacaaagacttttttggcaaagaatcattcctgaccgtctccggccagctcaatggtgaaacctatgcctgtgcgctgtccaaaatctatacttttgggccgaccttccgcgcggaaaattccaacaccagccgccacctggcggagttctggatgctggagccggaagtggcgttcgccgatctggaagacaacgcccgtctggcggaagccatgctgaaatatgtcttcaaggcggttctggaagagcgtgcggatgacatgaagttctttgccgaacgcgtggataaagacgctatcgctcgtctggagcgttttgtctccaccgactttgctcaggtggattacaccgatgcggtcgccattctggaacgctgtggtaagacatttgaaaacccggtgttctggggcgtcgacctttcttccgaacacgaacgttatctggcggaagagcatttcaaagcgccggtagtggtgaaaaactatccgaaagaaattaaagcgttttacatgcgccttaacgaagatggcaaaaccgtggcggccatggatgtgctggcgccgggaatcggcgaaatcatcggtggttcccagcgtgaagagcgtctggatgtgctggatgcccgtatggccgaaatggggctgaataaagaggattactggtggtatcgcgacttgcgtcgctacggtactgtaccgcattccggctttggcctgggctttgaacgccttatcgcttacgtcacgggtgtgcaaaacgtgcgcgatgttattccgttcccacggaccccacgcaacgccagcttctgatttttacgtcacactcaaggccagctatgctggccttttttttcgcctgaatgtcagttttattatcaataagtaaataaatttaattacaaccctctgaattacaacatcttgttactgtatatttcacgaaaatatttacacataaaaattaatccttaattttattgcggattagatttttctgctctaatagcacaatttttcaccacaatttcggacatcaagacttctaaatggctatttttatgaaatagctcgtctgctgttttttcaggcacaacggtgtcgcaaaccaataaatgtaataaaatcatagtgataaaataaaaataatcaaatcaaagcgagaactcaggggaagtttgacgttgttcacaaagttccgcgaaaataacatttatttacatatttttccttttgaaaccaaatatttatatttgtagcactttcacagtagcgaaacgttagtttgaatggaaagatgcctgtcagacacataaagacaccaaactctcatcaatatttctgtaaagttttattgacagaatttattgacggcagtggcaggtgtcatataaaaaaaccaatgagggtaataaataatgatgaagcgcaaaatcctggcagcggtgatccctgccctgctggctgctgcaaccgcaaacgcagcagaaatttataataaagatggtaataagctggatctgtacggtaaagccgtgggtcgtcacgtatggacaacgaccggcgatagtaaaaatgccgaccagacttatgcccagattggttttaaaggggaaacgcagattaacaccgatctgaccggtttcggtcagtgggaataccgtactaaagcagaccgcgctgaaggcgaacagcagaactcgaatctggtacgtctggctttcgcgggtttgaaatacgcggaagtgggttcaatcgattatggtcgtaactacggtatcgtttacgatgttgaatcctataccgatatggccccctacttctccggcgaaacctggggcggcgcctataccgataactacatgaccagccgtgctggcggtttgttgacctaccgtaactctgacttctttggtctggtggacggtctctctttcggtatccagtatcagggtaaaaatcaggacaaccacagcattaactctcagaatggcgatggcgtaggttacaccatggcatatgagttcgacggctttggcgtcaccgcagcgtacagcaacagcaagcgtactaacgatcagcaggatcgcgatggtaatggcgatcgcgcagaatcgtgggccgttggcgcgaaatatgatgcaaacaacgtctacctggctgccgtatatgctgaaacccgcaatatgagcattgttgaaaatacggttaccgataccgtggaaatggcaaacaaaacgcagaacctggaagtggtcgctcagtaccagtttgacttcggcctgcgtccggcaatctcgtatgtgcagagtaaaggtaagcagttgaacggcgccgacggctcggccgatctggcgaaatatattcaggcgggcgcgacttactacttcaacaaaaacatgaacgtatgggttgactaccgtttcaacctgctggacgaaaacgactacagctccagctacgttggcaccgacgatcaggcggctgtcggtattacttaccagttctgatcagcagacccctttgttttatgcctcaaaaacaggacttcggtcctgtttttttatctctcttagagaaaatgtgcgtctttcaaaaacaggcgggctttttagcgctaacggttggcattttgtaaatctgccgttaacctgatagcggatttcccttctgtaactataatggaacctcgtcatgtttgagaacataaccgccgctcctgccgacccgattttgggcctggccgatctgtttcgcgccgatgaccgtccagggaaaattaaccttggcattggcgtatataaagatgaaaccggcaaaacaccggtgctcaccagcgttaaaaaagccgagcagtatttactggaaaatgaaacgacgaaaaactatctcggcattgacgggattccggaatttgctcgctgcactcaggaactgctgttcggcaaaggcagcgcgctgattaatgataagcgcgcacgcacggcgcaaacgccgggcggtaccggcgcgttacgcattgccgccgactttttggcaaaaaatactccggtaaaacgggtgtgggtgagcaaccccagctggccgaaccacaaaagcgtgtttaacgctgccggcctggaagttcgggagtacgcttactacgatgcggaaaatcactcgctggattttgaagcgctacaagccagcctgagcgaagcacaggccggcgatgtggttctgttccacggttgctgtcataacccaaccggcattgaccctactctggaacagtggcaggttctggctgagctttccgttgaaaaagggtggctgccgctattcgatttcgcctaccagggctttgcccgcggcctggaagaagatgcggaaggtctgcgcgcctttgccgcgctgcataaagagctcattgtcgccagctcctactccaaaaacttcggcttatataatgagcgcgtcggcgcctgcaccctcgttgccgccgatgcggaaaccgtggatcgcgcttttagccagatgaaatccgccattcgcgctaactactccaacccaccagcgcacggcgcgtccatcgtcgcgactatcctgagtaatgacgccctgcgcgctatctgggaacaggaactgacggacatgcgccagcgtattcagcgtatgcgtcaactgttcgtgaataccttgcaggaaaaaggcgcgaaccgtgacttcagctttattatcaagcagaacgggatgttctcattcagcggtctgaccaaagatcaggtgctgcgtctgcgtgaagagtttggcgtttatgccgtggcttctggtcgcgtgaacgtggcgggcatgaccccggataatatggcgccgctgtgcgaagccattgtcgcggtactataaaaagctgccgactggcgtgaccgataaaaaagcctgcacattgcaggctttttcattctgcttaccagaccggcatctcatcttgcaggaaggaattatgcagacgctcgtatccgagcgtagagagcgggccgtggccaggaataaaggtcacatcatcgccaagcggcaataatttacgcttaatggcgtcaatcaactgggtgtgatcgccgcgaggaaaatcgctgcgcccgacgccacctttgaaaatcacatcgccggagatcagcagttgcgactgttcatcaaagaaaaccacgtgtcccggcgtgtgtcccggacaatgtaacacctgtaacgtcacattccccacgctgacgcgatcgccgtcgttcagccagcgatcaggcgtcagcggctgacactcatccagaccaaacatgcggctttgcgccggcagtccttgcagccagaactcatcttctttttccggaccgataacaggaacgccgtaatgctgcgccagttcactcgccgcgccgacatgatcgagatgcccatgcgtgagtaaaatttgcatcaacgtcacgccgctggcgtccacttcctgtttaattttttccgcgtcgccgcccggatcgaccagcgccgccagccgggtttgttcgcaccagattaatgaacagttctgggagaacgcggtgaccggaataatacgatagttcatactgctcctttgattaagcctcgctgattaccagtgccgcgctggcccggtatcaatatgcacaaagttactacgtgggtaatatcctacaccacctgcgcgcatagataacgccgctttgcgaatattgctcagcgccacgccctcaatatgaaaatccatcgcctgcccttttgtatggtagctttttttcgctacgccgctgctacgggcgcgtaattcattattggtatcaagagaacggtagcctgagatgagctgcacaggtttacgcgtccctaacagcccctgaagtcggtaaagttggtcaaacaggcggggatcgattgatcggactttattcgcgcgatagtcacggaaaaaatggtttaactttgctaattcatcctgaatgtaggctcttccatcgaaaaactccgccttgattgactctccggtatggagattgtttaacgtcaaaatgcgcgggcgtggggtcgagagtgtggcaaacgctggcgagggcaggatggcggcgccgagagcgacaccaccaagcgccagcagcttgcggcgattagcgtcaaatttgtccatgataatcaggtctacaggtcaatgttatcgttaatacacttctacctttaagcagacatgataccggctggcacagacttctgaacggcccggtcgacttaaaggttgttgtatatgcacttctggcgcacgaaaggcaccttaactggcgataaagcccgcgtcaagatggccctcccccagccacaacgggggtctacagcgaaacgccccgttgaagccaaacattaggacaacatatttaccagaacttcttcatttacctgattaattgttcaacctttggcacaatttgtgcgctggatcgcgctgtgagatcgtaattgtaaatatctgtacgatattgcatacgtccatctgcgccgacaaacgcggtcagatagtaaagatttactggaatgttctgccggatattgacataccgcgtgtcgccttgcttcagggcgccagagatccgcgcatcgttccagccagcatcctgcaaaagcatattcgccagttcagaggccttattgacccgcacgcagccggaacttaacgccctggcgtcacgctgaaaaagattatggttaggcgtatcgtgcagatagatcgcatctgaactcggcatattaaatttataacgccccagcgaattgtgcgcgcctggcgcctgctggaaacggaacggaagattcgatggcgtaatggtggcccagtcaacctgccacggatcgatcgcttctttgctgttccagccgcgcatcacggtgtagccatggcgctccagatagcctgggtcattccacaccttcggtaaaatgtctttacgcgcaagcgtgggcggaacgttccacggcgggttcaccaccacattattcagcgcgctgctcatcatcggcgttttacgatcgggacgcccgacgatcacccttgaagccagcacctggttgccattctgatagtagaccagcgaataagcgggaatgtttaccataataccggtagagagttccgccggcagcaggcgtaaacgttggatattcagtgccagtacgcctgcgcgttgcgcgggggtcatattaagccagttacgcgtcgccgggccaatgacgccatccgcccccagtccttgccatgcctgaaaacgctttaccgcctcgaccagttcacgatcgtaggcgcgtgccgccggagccggcttactacggcgggccgttggttcgtcgaccggctgcgccaccgatgtttcgtcgactacggcggaggggctgacgacggcactatcagaggtgttatcgccgggtaaggctatctttggaccgccatccagcatccccgtacgctgtaatatttcgcgcagcgcaggcacatcgttactccattgccccgggcgcagcgtcgcggtattggtcaactgcggccacgggcgagagtccgccaccagcttcagcagtgcgtcatgcatgggcgcatactgtggatgctgcggcgccaggctggcgacaaacatcggcaactgcccctcttccagcgcgatttgccactggttaatcaccgagactggcggcgtcgccaatgcgtaaggtttgttgctatatagccagcgttggcctttgacggggatattcgcaatgaaatggagatagcccatcatggcgtctgacaacacaacatcgcgcgccataccgtttacggcgggagcggtcaacaatgccacccaggcggtaaactgcggctggaatccggcgatcgccacctccgccaactgttgctggaaggctttcaccgcatcgcgattatcccacatgggcttcatgtcgcgcgcggcatacagcaatgtcagctggctcatatagaccggcgtatagccggaaggaagctgcgactgtaaatcagcccgaactttctcggctgaaacgccctccggcagcggctgaatcccggccagaatcgccgtcgcggcggattgcttctgcggcccagcctgacccgtcgcggcaacggcgctatcgccaggtatcatttcaggctcatcggcctgcgcattgaacagtggagcgaatgttacggccaggcataaactgattgccgacagacaacgaccacacatcttattaagcaacatcccttgccccctgttttcgttatcatactccgcatgactgtgctgcccgcagcgcgggtcaacctcaaccaatgcttttgtttagtatgacgagtcagcctgctcactcgtcaggcttaactccagtatataaagttcgttacgtttttgcctaacctaatgtaaagaagtttaaagaaaatacactacccggagagatttttcagataaagaaaaaggcggctttcgccgccccaggctaatgataaagcagaacttgttatgccggatgccggcataaccgacttatccggccttgcctgataagcgaggcgccatcaggcacttcatcgtttctgccgtgtttaactcgcttctgaaggcgtatcttccgcctgcgtaccgggaagcgtttccggaagctgcggcgcaaagccacgcagcccgacaacatgaacatgctcagtattctgaaacactttacgcaccagtttatacgtcgtgcccttctccggactgatgttttccggcgcagcgatgatgagctgcatctgcaaacgttcgcatagttcaaacagcgtggcgatagagcgcgcatccagacgcgccgcttcatcgaggaacagcaggcgacatggcgaaatatctttcccgcgcagtctgcgcgcttcgtcttcccagctttgcaccaccatcaccagaattgacatccctgttccgatagcttcacccgttgatagcgcgccggattccgcacgcagccagccgtcagacccacggttaacttcaacttccatttccagatagttacggtagtccagcaactcctcgccgatggtctgcggcgtgcgttgacccatatcgatctgcggattcaggcgctggtacagtttcgccagcgcttcggagaaggtcagacgattgctgttaaacagatcctgatgctgctcctgctgttctgaaagcacatccagcaaggtggcatgcgtttcacgcacgttgacgtttaaccgcacgctattcacctggccaaacgagacgctttgcaaaccctggttcagcatacggatacggttctgctcacgctggatagttttgcggatgatgtttgccacgctgcgggaactgatcgccagcttttgctcacgcgatgtcagctcttccgtcagacggctcagctcaatctccatttgttcaatggcttcaaccggatcgtcggtacgaataatatcctgacgaatacgctcgcgcagatgctggtaaacggccacaaagaactggattttacgttccgggcgtttcggatcttccgacagacgcaatacgtcgcgcagatgttcgttatccgcgacggccagacgcagcgcgcccaacgccttatccgacatggagcgcagttcatccgccgacagataagccagctcacgacggtgcagacggcgttccacgccattgtctttcaccatccgcatgaccgcgcaccagccggctttcgcggtcacgacctgctcgcgcatttcatgataatcgcgctccagcttgcgcagcttacgggtcaggttctccatctccgcttcgcagaaggtgagcgctttctcaagctgattgcgacgcgaacggttattgctcaactgagcgtgcagttcatcccgacgctggcgggcgcgctcttccgccccgctgtcggcgcgaacgccaatgtcctgtaattcgcgctgcaaatcgttaagcagctcttttttcgtgtcgtaagagctttttagcgaggccagaacctggctgtactgacttaactgcgcggcatggctgcgcagcgcttcgcgggcgcgggtacgctcggcttccgcctgctccagccgctggcgcagcttttcgttgagatcgctgttgccgctcagcatttccgccgagtcggaatagctgaaatgcgcccgacgttcgacaacttcagccagagcaaaagcctgctggcgcgcgtcgcgctgcatttgctgcgaccatgcatagtcttcttttaattgctcaaactgttccggatcgctttgcagaacggaaaccattggctccagtttggctaactggttgccatattgctgcacaaatcgcgccgcttcctgcgcctcatccaaccgctcctgaatttcatcgacccgatcggccagcgtttcatcggccaataaattcagccgcggcagcaaacggttaagcgcggaaacgccctctttggcctgctcaaactgaaggcgctgctgctggttgtcgctttcatgcgtcgccagcgcgcgctccagctcgacgcgacgcccgttcagtcggcgaatttccgcttccggatcgtcctcaaaggcaacggaaaggtggctaccgataaaacggctgaacgcctggtgcaaacgctgggttttctgcacgtcaaacgagagcgtggcaaagcgctcggaaagcacttcccgttccgcatggagactctcaatacggttctcgcgcgccgcgcggccaaaaataggtagcgacgggaaacgcgaataacgccactgacggtcggcaattttcacgaccaccgccttttccagctcgtcaacgctgaatacgctgtcatcaaaagactgcggatcgccttcgatcaggtacagatcttccgggcagtcggtcagaccttcaagctgttcggctatttgcgataaatccggtacgacgatcgcatggcgcgacgggccatacagtgcggagaagtacggcgcatcttcaagactgacatcgtcgtagatttccgacagcagtaccccgccaaaacgctccgccagcgcattcaaacgctgatcttccgcaccgcccggctggcttaaacgttcgatctcttcatcaaccgcatttttacgtgcgcccacttcgtcgcgttcgacaatggcttcgcgctcacgctccagtagctgttgcaggtattcggtcacttcctggctggacgtaaactcctcgccgcactgttcgctaagctggttcaggctattctgcgccgccagccagacaggagcgcgttgcatcagatgctggatacgggattgcagctgttcctgttcctgacgcaaggccatacgctgttcgctggctgacgacacgctctcagacaaggacgcgatgcgggcttccagctcctgatgcagcgcttccagttcgtcaatatcaaaatttttgccctgtcgcttacagaactccgccagcagacgttccgcctcttgctgctcgcgcagccgctgttccagttcgctcaggcgcatccgcagcggctgtacctgttccgccagatgacgctggttcacgccgtcccgtaacagctcgcgcgccacgtcccaggcttcgctacgcgccagcgggccgttgatcgccgccaccagctggtaagcctgctcaaactggctgtgcgcggtttgcgccacgctcattttttgttccaacgacagcagtttttccgtagcttcctgctcttttgcctggaaagtatccagccattcggcggcgctttccggcgttagatccggtagatggcaaagttctttagcgcgggcaagcgctgatatcgcctggttatactgaatcgcgcgcgtttgctgtacatccagcgcctgctggtaatccgcaagctggcttttgagttcatcgacttccagctcggcggcttcggcacgcgcttcattttcgtcctgcatttcggcggcttccgccaccacttcattttgctcttcgaatcgaatctgcagctcttcaagatccgcttcgtagcgttcaattttttcctgctggcgcagcgcggtttgcaccagattcaggtgatcgctcgccgcctggtaatccgcttcaagagaaccttcggcgccgttatgttcgcccaactcacgggccatatcgacgtgcttgtactgctccgccgccagttgtttgcgcgatgtgtacagttcgcgtcgaaacgccaacgcctgatcaaggtgaacccgacgctcattggcgtggcgcatataatccgccgccacataatcggtggcttcgctgatcaaatgcttaaacagatcgcgatcggattgggtaacacgaatcgcttccagcgtgagtcggttctcgcgcagcgccgcttccatatcctggaacgccttgcgcacgccgctgttttccggcaataaataatcgcgtagcgatcgggtaatggcgctggagatcccgccgtacagcgaggcctctatcaaacgatagaatttactacgatcggaagcggaacgcagacgacgggcgataatccctaagtcaaacatcagcgaatgataatcggtgatggagttaaactgcttaaactgcacgccttccatctcgtcaagcttgtctttcagctcagcaagcgacagtacgcgcgcctgacgttcgtttaatgtctccgtcaccagttgtgtcggctgtaccgacatcggcagcccctgaatagcgaacggtttgatgtccactttgcgatcgcgcccagcgacctgctgcagacgcacgccgaccaccacccgctgatggcgggaattaatggtgtcgagcatggagtaacagacacccgccttcagcttaccgtgcagacctttatcgcgcgaaccgctggtggcgccggcttccgtggtgttacgaaagtgcagtaatgtgagatccgggatcagcgccgtgacgaacgccgccatcgtcgtggatttcccggcgccgttgcccccggataacgtcgtgaccagttcatccaggtcaaaagtgcgggcaaaaaaaccgttccagttaatcagcgttagcgagcgaaatttaccgcgttcaatcattattcttcctctccactgtccggctgactctcttcggtctcatcattaagttgcagatggttttcaatgggcatcgcttccccgtcgcggatgagacgacgctgcgcctcgcgaggatcgtcgccggcgcggacatccgcgccaaagcggaagaccgattcggtaatgcggaatttgctgctgtcgtggcccataaaccataccatgcccaaacgacgcaggcggtttaaagaagaacgcaccttttcctgcagtttctgacgatcaacgtcagatcccgtcgaacggttattcaccagctttagcagtttggcttcgtccgcaagggtaagcagctcgtcgtacaactcctgctgagtaaagatcccttcgttggccagacgctccgggctaagatagaggtagcagagaattttaccgaccatcatatccagttcggataacaccgagcgcgggataagcgtggtagaacgcggacgcaggtaaaagaacccctccggcgcacgaatcaactccacgttataacgcgcgtaaaactcttccaggtattcctgaaaatccatcagaaaggcatgattatccagttcgtccagcccgatgtggcggcccgaacgtaatgcgctatccagcgccggaaataacggattcgccagcgcctgcgccagcttaaccggcatcacttgttcaatatttgtcaatgacatgcgcctgtaccttggctccgtaatcattaatcggctgccatttggctggcagtccggtgaaatctgcttgcgctacgccaagacgtaccgcttgatcgataacaatacgcgccacgtcgaaatgacgcgcgcgcgggtattgcgccagatactcgcgcaccaccagcccaagatccagtggcgtttgtctggttttgtagatagccagctgttcttcaatgatggccgctaactgctcgcggatctcgttaaactcttcatattccagatccggcggcaactccccggtgacttcatcgtcacgcaacgccatctcttcatcgcgcatatccagcagacgatcggcattcgcgtaggttagcgcccacggatcgtcaaaataagtctgcacggactggcgcaaccgctgggcgaagatacggtttttatccatatcgatcgcggtacggataaatttatgcacgtgacgatcgtagccgatccataaatcaatagactgctgaccccaactgataatgcggtcgagtttactttgtaagtcaaacaccagcctgtcgacaaaatgcagatcgtcgtgcgtcatcgtggcatcctgaatgcgcagcaggttagcctgcagcttatcgcccgccgcctccagcgtatcctgcaactcgcgcagcgtaccggacgtttcggaaagcagcagctcacagctggaaatcgccgcccgccagtctttattcagcagttgtgcgatatcgtctttcacctgctgctgctgttcatccataatgcgctgggtgagatcgatactgtcgaaaatctccgccaccgaatatttcaatggcgcgtaaacattgcgatgccagtggaactcatcgcccccctccgctgccgcatccgccgcgcgcttcaattcgccggccacaatcgacaactgcatagaaagacgcagcgtagagaattcgcgttgacgaatgtagtaatcggtgatgccaatcccgagcggggttaatcggtaaatcgcattgccttccgcctgctcgctggtaaagcggttcagcagacgttgacgcaccatatcgttaatcgcgttgttcgcgcgcacgccgatggtttcgctggtttgctcaaacgcatcactcacatggcggaatgcatccaccagctcgccttcactcatctcgccgtcaaggcgttcgccgttcaacgtggcgaccgccagcagaaaggaaagtctgtctaccggcagcgagatggaaaagtcgttttttctggcccaggcaaccagttcggggactgtctgggaaaattcactcataggttatccttgcatctgcggctagcgccgggcttttaatcgcggtgacatgaatgtagcgcccaaggctaatatacggctcctggcggcaataacgcgtttccagttcgaccagggtctcataacagtcacgctgctggtgtttttcacgcagataatcatgaaacacacgcacgccggttttaccggtaatctgccagccaatcgcctccagccactggtacacctgcgcggggtcgcgcgggtagtcaggcgacagcgtgcgcttcttgcgtttaggcatccccgcctgcacgtagtcaaaattacccgccaccatattgtgcatcagcaaaccgttagcgttatagaacatcaacgacagcgcgccgccagggcgcaatactgaccagagcgtttctaatacgccgacaggatcggctacccactccagcacagcatgaaacaatatcagatcaaccgggctttccaaatgcgaagcgacgtcctgagccgggcattgtataaaatgcatgtctttgctcacaccttttgcctcggccgcctgccgcgcgcgggcgatcatttcgccagacagatcgcataacgtcacctgatggccgcgttccgccatcttaatcgccgtttgcccttcgccgccgccggcatccagcacccgcagtttccgcccgccaatctcctccagcacgcgatccaggtcttgccacagaatggcttgccgcagttgccctttggtcgtgccgtaaatgttacgggaaaacttttcagcaatgtcatcaaaattgcgatcctgcatcggactctccacaggctggctcaggcgttatctgataaaaccgctattttgtcacagccgcggcgagaatgaacctgtctggtgtaatatcaccgttaatcctccgctatatggttaaaaaaggaaccaaaaaggatgctttttacgctaaagaaagtgattggcggcatgttattgccgcttccgctgatgttgctgatcattggcatcggcctggcgctgctctggtttagccgctttcagaagaccggaaaagtatttatcagcgtaggttggctggcgctattgctattaagcctgcaacccgtctctgaccatttgctgcgtccgatagaaaaccgctaccctacctggcagggtccgcaaaaggtggaatatattgtggttctcggcggcggctatacctggaacccgcagtgggcgccgagctctaatttaattaacaacagcttgccgcggctggcggaaggcattcggctgtggcgcgcgaatccgggagccaggctgatttttaccggcggcgtagcaaaaaccaatacggtaagcacggcggaagtcggcgcgcgggtggcgcagtcgctgggcgtaccgcgtagcgatattattacgctggataagccaaaagatacggaagaagaagccgccgccgttaagcaggccatcggcgacgcccctttcctgctggtaacctccgcctcgcatttgccgcgtgcgatgattttctttcagcatgccgggctgaatccgcttcccgcgccggcgaatcagttggcgatcgattcgccgctcaatccctgggagcgggcaattccgtccccggtctggctgatgcacagcgatcgcgctgggtatgaaacattagggcgactttggcaatggctgaaaggcatatcaggcaagccaggggagtaatgatttcgccgccagatcaaaattggtacggttaaaacgtccggtattgaccaattgcgcaacctcgtcccacagcacatagagccaacgccgccagatgaatgactccgccactggcgcgcgttgcagataatgccaaagcaatccctccgccaatggattatccatcaggcgaaacagttcgaattctctcggcgcccacagcatcagcccggggccgaccatcgccagaagctgatcgctacgggcgtctttaagcatactgcgcaagcagaagttgccatgcaccagtacgcagttgtcgttaaacccttcaaataacgaaggaagatattctctggtacgaaacagaatgcgtttgtcctgcatcgtcaggccggtattgctgaactgatttagcgtcgtccacagcacctccacacgctgacgataccaggaaggccagatattctcctgagtatggtctacggcgcccacgcaaccgcggctatcctgccgatgccaggctaacaatccttcgacaatctgatcttttagctgttcccagcgttccggagtgcgcgccggcgcctcgaccggcacaccgcgcagtcgttccagtagcagcacatccagaccaggatgctcttcatgcgtcaatacgccatagattaccggcatcctcaccgtaccgctacgcgccagcattgaggttttccatgccagttgctgcgcaacgccaggagtggtaaaacttcgcgccatcagcggcatcggatttccctggctgtcatataatgaccacaatgcggaatccgctttctcattcacgcactctatacggctaagtttttcacccaacaaatgactgagttcggcccgcaactgttccattccagattacccccattagtgctactgctttaataatgagcgtcgtatggacagatgtcacccgtatcagatcaagggaagaaaagaaaaatgaggaaaatcgtaacggtacgagaaagccgccactgatgagcagacgtgagtattcatctttgcgctatcataccgcgctgttcatgaccgtctaagacgatcatgaacaggatcatgttaacgcatttcagcgcgcacgcgctccaggtcgtcggcggtgtctacgcccgtgccgggcaccgctttggcgacagcgacatgaattttttcgccgtaccacagcacacggagttgctccagcatttcaatatgttccagcgggctgggttgccagctcacgtaacggcggataaatcccgcgcgatagccataaatgcccaggtgacgaaggcaagtatcccctaccgtttccagactttttgcaaagcgatcgcgatcccagggaatcgtcgcccgggaaaagtaaagcgcatagccttcagcatccagcacgacttttaccgcattcgggttaaacgcttcttcggcgctgtgaatcggcaccgccagcgtcgccatgccaacctggcgctgcgccagattttccgcgacctggcgaataataaccgccgggatcatcggctcatcgccctgaacgttcacaataacggtatcgtcggtgaatccgcacttctctaccacttccgccaaccgttcggtgccggactggtgatcggcgcgcgtcatgcacacttcgccgccagccgcttctaccgcacgagccacgtcttcatgatcggtcgcgacaataatgcgttccgcgccagattcgcgcgcccgctccaggacatgaacaatcatgggtttaccattaatatccactaatggtttgcctggcagtcgggtagatgaaaaacgggccggaatgatgacgacgaaactcatgatttactctcatcagatgtcagggcgcgagcttcattttccagcaatacaggaatgccgtcgcgtaacgggaaagcgagattatccagtttgcaaattaattcttgctgttcctggttataccagagtttgccgttacataccgggcaggcgatgatttcaagcagacgatgatccatagttcctccagatggaccggattgtgaatccttcaatattaacataatcggttatggtgcagggtctatttcccagccatgacgcatggcgctaaacaggcctggcggacattgtcccagcgtcacgcgcgatgctcgttgccaggcagcaaacgcgctaatggcctgccagattcctttttgcagactaacgccagggcgaatatcgtcctccagatacagcgagataacctcaagcacccccgttttacggtgcattttggcgtccattcgcccgactaaacggccctggtataatagcggcagcacaaaataaccgtactggcgcttcgccgcgggcgtataacattccagccggtagtcgaatgcgaagagctgcgctgcccgcttacgatcccataccacaggatcgaaaggcgacagtactgcgctatgggtcgcctttaaggcgttatttagcgccggttcaagctgcgaaagaagatcggcatgaagccacatccgccccaacgtttccacctcgaccggaataatctgctgctgttccgcccggctctcccgctatcctttcaggtcaggacgtttcaggcggtagtaatccgccagccactgttcacggaaaatccccagactgcgcgcgctattatccagcatcaggctttccgcctgcggctgtgacagtccatcgcgttcatcatcccagtgcggcatcacacggggcgttaaatcatatacacgttgaaaattacgccgctcaacaaccatgacttttccggcggtaaataaaccctcaaggtggcgtttatgtggtttccattcccaccagccgctgacgcctttctgcgcatgttcaaaatcggcagaacgcaccggaccatgctcctgaatatgccgcaccagctgttctatttcttccgcgtgctcatgcatccatgccgcgcgatatttccagcccattttttccggcgacagcatacgatggcggataagtttaaagtcgcggcgtggtaagaaacaggcctcatgcgcccagtattctattaactcgccgcgtcgcagcgcctcatccagccaggcctgcgggtacgaaccgagacggctaaacagcaccagataggggctacgtgcgacaacattgatggtatcaatttgcagcaacgccatgcgtgagatggcggcaagaacatcgccaggcatcgcgttacggcgcggctttttcaatagcccctgcgcagcaaggtgaagacaacgggcctgggaaagagaaaggtacggcaatgacattcatgactccataaattcatcactgccgctgcattggggtacgctagcgaaccagcgaggtgatatgttcaagcaacttatcaggctgctcgccggacaaacgcgcatcaaccggtaagaaccaccagttatcttcggcgaaagcacggcatttcaccgcgtctttttccgtcattaccagggtctgcccttcaccgaccaacgcctgaacgtcagcaggggcgagcgtttgatgatcggccagcgggacgcacttttgcggatgcgcgccacaggcttccagcgtggcgaaaaagcgcggcggatgaccgatgcccgccatcgccacaatattgctcagttgcgccacatcgcaacgcgctcccgtacgtaagttcaccgccagtccaggcgctagctgcatggggatttcgcccgcccgggcgacgccgccattcacgatagcggcgtccacggttttcaggcgactggcgcgttcgcgcatagggccggcaggaagccaccagccgttgccaaaacggcgcaccccgtcaatcaccacaatttcaatatctcgcgctagtcggtaatgctgcaacccatcgtcggtgataataatctgcacattatgcgccgccagaatcgctttcaccgccgcggcgcgttcaggcgccaccgcgacaggcgcgccggtccgctgataaatcaataccggttcatctcccgcttctgcggttgtcgtctcaggcgtcaggagcagcggataagcggcagctttcccgccgtagccgcgggaaacgacccccacgcgcacgccacgctgttgcagcttttccaccagccaaatgactacgggtgttttaccgttaccgccagccgtaagattccctaccacaaccaccggtaccggcgctcgccaggcgcgtttcaaaccaagcttatagctcagacgaatcgccccgctcaccaggccatacagccaggagagcggcagcagtaaccgccatagcggggattcacccgaccagatacgcgcaatcattggccaaattgcatcttatgcagctgggcgtaaacgccgtgttgcgccagcagctcgctatgagtgccgcgctcaacgataataccgtcttcgactacaacgatctcatccgcctgttcgatggtggagagacggtgcgcaatcaccagagaggtacggtttttttgcagctcatccaacgcggcctgaatcgcacgttcggactcggtatccagcgcggacgtagcttcatcaaggatcagaatcgggctgtcgcgcagtaaggcgcgggcaatcgcgatacgctggcgctgaccgccggaaagcagtacgccgttttcgccgataatggtatccagaccattatccatcttgttgataaagtccatggcataggccatgcgcgccgcctcttcaatctgctcgcggctgtattcttccgtccgggcataagcaatgttattggcgaccgtgtcgttaaacagatgcacgttttgcgaaaccagcgccacctgattacgtagagaggccagagtgtattcgcgtagatcgtgaccatccatcaggatgtgtccttcatcaatatcgtagaaacgggtgatcagactggcgatagttgatttacccgatccggaacgccccaccagcgccacggttttcccggcaggaattttcaaattgatgttacgcaatgccggcacttcacggcccgggtaagtaaacgtcacattgcggaattcgagatcgccggtcgcgcggtcaatgacacgtttaccttcatctttctcctgttcgctgtccagaatcgcaaacaacgtctgacaagccgccatcccacgctggaactgcgcgttaacgtttgtcagcgattttaatggacgcatcagcgcgatcatggaggagaacaccaccgtgatggtccctgccgtcaggctatccattacgcttgggaagctcgcagcatagagaacaaacgccagcgccagcgaggcaatgagctgaatgataggatcggaaattgacgaggcagagaccattttcatgccttgcagtcgcatcttattgctgactttatcaaagcgtttagtttcgacttcctgaccgccgaaaatcagtacctctttgtgtcctttcagcatttgttcagcgctggtagtcacttgtcccatcgtgttctgcatatttttactgatgctgcggaaccgctttgagacaacgcgaatcgcaatcgacacaatcggcgctaaaacaaccaggatgatcgacagctgccagctgtaatagaacatcataataaacaatccgatgatcgatgccccttcacgcaccacggtaatcagcgcgccagatgaagaagaggcaacctgttctgaatcgtatgtaatacgcgacagcagcgtaccggtagactgtttatcaaagaaggcgacgggcattcccatcatatggccaaacaggcgacggcgcatggtcattaccaccttgcctgacacccatgaaatacagtagctggagatatagctagtgatgcctcgtaatatcatcagcccaataaccaccagcggcatccacagcaacactgagcgatccgttttaccgaaaccatcatccagtaatggcttgaggagcgatagcatgaaggtatcgctggctgcgttgagaattaacgctatgcccgccacgatcagacctgctttaaaaggcgctatggttggccacagtcggcggaaggtctgccacgtagagagatctttatcgttatgcattcaaaaaaccagcatttgttgaaatagccgcatattctacccgttatcctcggacacgccaaaccactgatgataccagcgaggtaaaatttgatcccgtaagccttgtatgcgccagccctgcggagaaaacagcagcgaaatttgcccctggtggggtgtatcaaaccactgatacgcctgctgtcggtagcgctgttttaccttgcgggacggcagccgccatgcgttatagcgcgatgcggacgccagcgccgcttcaccatgtacgcgctgaataaatggtaacgacgacgacgtattactaccatgatgcggcacctggataaacgtcgccgcaagatgtcgccagtaacgacttagcattttttgttcagcgcccgcttcgatatcgcccgtgagcaggatgctatgtacaccgtcatccactttgaccacacaagaacggttatttcctcgatcggcactttcgcgtaacggccagtgcgcctgaaacgttagcccctgccattgccactgctcgccgcgaaaacagggcaaatgtccctgccagcctaacgggctgcgaatccacattgacggccagacctgctgtagcgaacgcagcccgccccgatgatccagatgctcatgactcaaaataacgccctccggcgtcagattatgccagcgcaaccagggaataataacctgttgcccgctgtcgccctccggccatgcccgaccggtatcgtagagtattactttatcgcccctgacgatcgctatcgccagcccctgaccgacatccagcatatgcacctgccatccgctggcgtttatcggccgccagagtggccagctcatcaacaataacccgcataaacagaccgccggccaggtacgccagacgtttaatcgccacgcgataagcgttagccagggtaaaagcgtcagccactgccaacggttatcaatattcacccagccctgcggtaaagcattcaacaggtaaaatagcgcggctaacgcgcgatcggtcaggtaccatacccactcttcaagaaaaaacggcccggttaaatgcagaatcattcccgccaggatgagtggaaccgtcacaaatgtgacccaaggtacggcaaaaagattcgccagcattgcggtaacgcttatgccatgaaaaagcgccacctggagaggcaaaagcagaagtgtaatgcctgcctgtaggtgaagcaggttaagcaaccagcgtaagcctcgtggaaaatttccgtttggcgcaggaaaccactgataccagaataacaggccggcaaccgcaaatgctgacagccaaagactttgtgatataaccgccacaggatcggcgaaaataatcgcggccagacagcagcaccagacttgccagccgctccactgtcgtccgcttaatttcaatcctccccagacgctcagtgccgccaccgtgcgcagcgcaggcggttgtaagccggtaagccaggcataacatatcgcgcaaagaatgccgcccagcaatggcgtctgccaacgaatccatctgaccggcaaaaagaattgtccgccacggattaatccggcagccaataacgcagcaaaagcgatatgcaggccggaaatcgccatcaaatgggcagtccccgtatcgcgcataacggccttcacctcctgcgacaccgctccccgctcccccattcccaacgccagaataacctgctgccacggataaggcgcaagcgtagcgcgaagcgaagcaagatagcgcccacgcaagctacactcagggttaatcgctttagcctgtagaaaacgcccggtcaacggttggtgctgcgccagcgcgtaacgctggctatcaaaaccgccttcgttaagctgtccgtgtaccgctctgaccttcagcgtcatcgcccactgctgtccggcacacacttccgtgggtaagtactggccatgcaggacaatccctacagcaggaaagagtggctttccatgcaaatgggtaattcgcccataatgagtggtcatatgatcggtggcagtaatgacgactgtcgcctcctgcgtcgcggcgggcaggacgtttcccacccagatggcctgcctggcggcaaaaatcccccacatgaaaaagagcaaggttaatgccgcgtagcgcgcatagtgatggggtatgaggcaaagcaaacatgccagacaaaacagcaccgcgagaatccacgtatcaggtaatactggcaatatcatgagcggaagtatgccgcatactacgcatacgctgaccgtcgttatcttcatagacacctccctgtgcgggaaagtgtgcaggttcaggacgccattgtctggaggggattttgtgctatacggcgcggattccaggttttttacctgataaatgtaagacgcagcaaaaaatgcgaaacgttttccagttttcggtcgaatagcgtttgcgcctgacggcgtataaatgaaaaaagcaccctgacggtgcttttttcgggttcaagttttgcgttaaaacttaaccgtaaatattggcgcgatcgcgcagttctttacccggtttaaagtgaggaacgtattttccttccagttccactttatcgccggtcttggggttacgtccggtacgaggcgcgcggtaatgcaaagaaaaactgccgaaaccgcggatttcaatacgctcgccctgcgcaagagtcgaggccatatgctccagcatctcttttaccgcgtcttcaaccgccttagcgggaatgtgagattgctgggttgcaagtctttcaatcaattctgacttggtcatgattcctccggttccttaaaggcaaattggctgcagccgtgagattgattaagggcggccgtagccgcccttagtgcttgattacaggccgaaacctgcaatctgtcaagtaatctcgttatacttcggactaaaaggcccgaagtttcagaggattactcgcctttagctgctttgaatgcttcagccattgcgttgttagagaagtttgcatcttcctgcttgttaacagttgcgatggcatctttctcgtcagcttcgtctttcgcacgaacagacaggctgattgcgcggtttttacgatcaacgccggtgaatttagcttcaacgtcgtcgccaacgctcagaaccagagtcgcatcttcaacgcggtcacgggatgcttcagaagcacgcaggtaaccttcaacgccgtcagccagttctacggttgcgcctttagcgtcaactgcagtgactttaccggttacgatagcgcctttcttgttcagagcaacccagttgttgaacggatcttctgcgagctgtttaacgcccagggagatacgttcacgttctgcgtcaacctgcagaacaactgcagcgatttcgtcgccttttttgtattcacgaactgcttcttcgcctgcaacgttccaggagatgtcagacaggtgaaccaggccgtcgatgccgccgtccaggccgatgaagataccgaagtcagtgatagacttgattttaccttcaacgcggtcgcccttgttgtgggtttctgcgaactgctgccacgggttagatttgcactgcttcaaccctaaggagatacgacgacgttcttcgtcgatatccagaaccatcacttccactacgtcgccaacgttaaccactttggacgggtggatgtttttgttggtccagtccatttcggaaacgtgaaccaggccttcaacgccttcttcgatttcaacgaagcagccgtagtcggtcaggttggtcacgcgaccggtcagtttggtaccttccggataacgtttagcgatagcaacccacggatcttcgcccagctgtttcaggcccagggatacacgggtacgctcgcggtcgaatttcagcactttcacgttgatttcgtcgccaacgttcacgatttcgctcggatgcttaacgcgtttccaggccatatcagtgatgtgcagcaggccgtcaacgccgcccagatcaacgaatgcaccgtagtcagtgaggttcttaacgatacctttaacttccatgccttcctgcaggttttccagcagctgatcgcgttctgcgctgttttcggattcgataacggcacgacgagaaaccacaacgttgttacgtttctggtccagcttgattactttgaattcaagctctttgccttccaggtgcagagtgtcacgcaccggacgaacgtctaccagagaacctggcaggaacgcgcgaataccgttcagctcaacagtgaagccacccttaactttgccgttgataacaccggtaacagtttcagcatcttcgtaagctttttccagcgtgatccatgcttcgtgacgtttagctttctcacgagagagcagagtttcaccgaagccgtcttctactgcatccagagcaacgtcaacttcgtcaccaacctggatttccagttcgccctgggcgtttttgaactgctcagccggaatggcagactcagatttcagaccggcgtcaaccagtactacgtctttgtcgatagcaacaacaacaccacgaacgatggaacccgggcgggtttcgatttcttttaaggattcttcaaagagttgagcaaaagattcagtcatgtttaatcttcaggtttcatatttaacgtccacctggctccgtgccggatggggttgtttaacatacccgctgtcaatcctttgcaacgggggtactacaaattcggtcgcatttaagcgagagccaatttttggcgcgcatattgtaacgctttttcaatcacttgctcaatgcttaatcgggtagaatccaaaactaatgcatcagcagcaggaactaacggcgctacagcgcgattacgatcgcgatcgtcgcgttccttgatctcggccaaaaggcgttcaaagttaacactaaagccattctcctgcaactgtagcatacgtcgatgcgcacgttcctccgaggaggcgtcaaggaaaatttttaccggcgcatccgggaagaccacggtccccatatcgcgtccatcggcgattaaaccaggcgcttcgcggaatgcgcgttggcggcgaagaagcgcttcacgcacgcgtgggaatgccgccacctgggatgccgcgttcgcgacttcctgcgtacgaatttcgccgctaacgtcctcgccttccaggataacttccaggttgccgtccgttgagacgaaacgcacgtccagatgggacgccagcggcaccagcgcatcttcagaggcgagatcgacatggtggtgcaatgccgccagcgccagtacgcggtatatcgcgccggaatccagcagatgccattgcaatgcttccgccattgctttgcacaaggtgcctttacctgcaccgcttgggccatcaatggttattaccggggcaattgccgtcatctttatctccttaaacaggcgtaccgttaacgtaaacgccgcgcattatacgcgccaacgctcgcgaccgttaacgttgcgtgcaaaaaccagttttgtctgtaatcagatgcggaataattgcgcaattatagcgggctggcgagaaaccagcccgaaagatgacaatgatttactttttatcttcggcaattctgtcgcgcatatgctgcgcgcgatcggctgaggccgggtgggagtccatcaatgattttgcatgacctgcgtccattatggcgaatttatcgaatgccgtgactaagccctgggtgttaatcccacgttttttcagcagattgtaagagaagtcatccgcatccgactcctgactgcgagaaaacgccaaattgatgacgccttccgccagatcgcccaattgagactgggaaagctgcgctgcgacgccgctggtggcggaaatcgcatcgcgagccgccagcgtggcataggcggtctgcattgccttgcgggagtgccctaaagagacatggcccagttcatggcccagtacgccttcaatttcattatcggtcatcagatccatcaggccggagtatacgcgaacgcaaccgttcgccatcgcccatgcgttgatatcgctggtcatatagactttatagctaaccggcgtaccgtcaatgttgttacccagcgctttagcgattttactcagacgtttggtgtatttgcttttcgaacctgccagttgattctcgctgtccatttgtttacaggcattattagataatgctttaacatccgcatcggacagtgtggcggctttgtaggctgacatgccggaactggcgattaaattgccattcacgccatttttacatcctgccagtagcgtggcggaaatcgccaccgccagtagtaatgatttatttttcatactaatcttccgttgataactattataaaaaacacataaatcaatgtgttaaatcaccaacaaattagcattagtcataattataaaaatagtgcgaatacggactcgacgcgccagcccgtcgactggcgcaacagaagaattaggcaggcgtactcatccgcgccagttgttcgaaataatcagggaacgtttttgcggtacatttagggtccaggatcgtgactggcgtatcggacagtgcgaccagtgagaaacacatcgccatacggtggtcgttgtacgtgccaatatccgcgtgttggagcttcgccggcggcgtgatacgaatatagtcgtgcccttcttcgacttcagcgcccactttacgtagctcggtcgccatcgcgaacaggcgatcggtttctttcactcgccagttataaatattgcgcaacgtcgtggttcctttcgcaaacaacgccgtggtggcaatcgtcatcgccgcatccggaatatggttcatatccatatctatggcgtgcaattcgccgcgcgtgcaggcaataaaatcatcgccccaggtaatggtcgcgcccattttctccagcacatcggcaaaacgaatatcgccctgcatacttttgcggccaatcccggtcacttttaccgtgccgccttttatcgccccagcggcgagaaaataggacgctgacgaggcatcgccctcgaccagatagcgacctggagagtgatactgttgaccgcccttcacgacaaattgttggtagtgatggttcgctatctccacgccaaaggttttcattaaatttagcgtgatatcgatgtaaggttttgataccagttcgcctttaacgcgaataattgtgtcttcaggcgccagcggcgccgtcatcagcagagcggtcaggaactggctggaaacgctaccatcaacctcaatgtcgccgccgataaaaccgccgcgcagacgcaggggcggatagttttcctgctccaggtaatcaatattcgccccaccctgacgcagcgaatcgaccagatggcctatcggacgctctttcatacgcggttcgccggttaacactatctcattttgccccagacatagcgctgccgctaacggacgcatcgcggttccggcattaccgagaaacagttccagagtgcctgacgcgcgtaatgggccgccattacccgtgatatcacagcgggtgcgatcggcagaaagggtgtaattgatccccaacgcgctcagggcattgagcatatggcggacgtcatcgctatccagcagattcgtcagaacggttttaccacaagctaaagccgccaggagcaaagcacggtttgaaacacttttggagccaggtaaattaatggcgccatcgacccgcgcgatgggttgtaacgtcagggattccatgaaactcaactctcaaaaaacagaaataaaaaccccacagactggccgtggggatgaaaaaagaaacgtattagccgtggcggcgctcaaaatcgatcatgaaatcggtcagcgctttcaccccttcaatcggcatggcgttatagatagaggcgcgcataccgccaacaacacggtgcccttttaaggcgtgcagaccagcggcgaaagactcttccagaaagaccttgtccagcgcattgtccgctaactggaacggaacattcatccgcgaacggttggcctgtgcgacatcgttacggtagaaatcgctgttatcaatcacaccatacagcaactccgctttttgctgattgattttgtgcatcgccgccacgccgccctgcgctttcaaccatttgaacaccagaccggaaagataccaggcgaaagtcggcggtgtattaaacatcgagtcgttatcattcaggacggtgtagtcgaggatggacgggcagctctcatgcgccttgcctaacagatcctcccggacgataaccagcgtcagtcctgccggaccgatattcttctgcgcgccagcataaattacgccatagcgagagacgtccagcggcgcagacaggatggtagaagaaaaatccgccgtgacgaccacttccgggccaaaatccggcgtttcatcgatggcgatgccgtcaatggtctcattcgggcaatagtgtaaataagcggcgttatcggaaagctgccactcgcgcatcggttttacggcacgtttgccgtcaacggtgattttggcgtcgataatctgcggcgcacagtattttttggcttctttgatggcgctcgccgcccagtaaccggcatcgacataatccgccgtggttttatcgcccagcagattgagcggcacgccagcaaactgcccgcgaccgccgccgtgacaaaataaaactttatagttggaggggatattaaggagatcgcgaaaatcctgctccgcctcttcagcgacctggataaactctttgcctcgatggctaatttccattaccgacgtaccaagaccgtgccagtcacgcagttcctgttgcgccagtttaagtacttccgccggtagcatcgccggacctgaactaaaattaaagacctgagccatttcccctcaccacgctgcattgtttcctgcctgacagacatcaggcaaacgttattcatgtgaatatcggttttatcattcagtgacacgcgccgcaatgggtaaaacaatgcgaggagaaaatgcggcatgcgtcacacaacagaatcttccggattaaccgtataaatccgatattttcgctgttaaacaacgcgtttagcccggcttgccttcgtccattctggatttgcgcagcgcggacataattgcttctccccgacattcatgcgtatcacttcactgcaacgtacgcaggcatagtcgccagcctccggcgccacgataaagcgtggcgtacagtgctcaggaagaatgcttaaccccggcttaacgtctttattttcaaagaaatagacgctgatttgtccgtttgtctccaggatggccagtctgacctgccccagttgctcaacgccattcaagcgaagctccataaaaaattcaaactccgtcatgttcgagcgctgcagtttttcccacgccagttcgccgtcttcaacaatgaccaccgacttgccttccagcagatcttccaacttttcactatgcgccatcagccacatgactaggcgatagagcagcgccagggtgatgaataccaccagaacagggagcatcggaacgtcatcataaaacgcgacgtcgcctgccgccgatcccaatgtcaaaatgatcagcacttcaaaaagcgacatttgccgtacgccgcgtcgtcctgtcacctttaagaaaagaaacaccagaacaaaggtgtaaaagctacgtagcgccacttcccccaaaaacgctaccgacacgttatccagcgccattcgttgcaaatcaaatgctttcattttttatgctcttcctgtgaattccagtgtaaaagcatagccaatacttttatttccgccgacgtcccggcgagatagcgcccgtcacataaaacccgtatcattgcgcgctttccgtacgacaaaagtgattttcatgacgcaaacatttattcccggcaaagacgccgcgctggaagactccatcgcccgcttccagcaaaagttactcgacctcggctttcacatcgaagaggcctcctggctgaacccggtgccaaacgtctggtcagtgcatattcgcgataaagagtgcgcgttatgctttaccaacggaaaaggcgcgaccaaaaaagcggcgctggcctcggcgctgggcgaatacttcgagcgtctgtcaaccaactacttttttgctgatttctggcttggcgaaacgatcgccaacgggccattcgtgcattatccgaatgaaaagtggttctcgctgactgaaaatgacgacgtaccggaaggcttgcttgatgcccgtctgcgcgcgttttacgatccggaaaatgaactcaccggaagccagttaattgatcttcagtccggcaatgaagaacgcggcgtctgcggcctgccatttacccgtcagtccgataaccagaccgtgtatattccgatgaatattatcggcaacctgtacgtctctaacggaatgtccgccggcaatacgcgtaatgaagcccgcgttcagggactgtcggaagtcttcgagcgttatgtgaaaaatcgcatcattgcggaaagtatcagtctgccggagattcccgcagaggtgatggcgcgttatccggcggtaatggagtcaatcgccacgctggaagccgagggtttcccgattttcgcctatgacggctcgctgggcggtaagtatccggttatctgcgtcgtgctgttcaacccggctaacggtacctgctttgcttcttttggcgcccatcctgactttggcgttgcgctggaacgtacagtgaccgagctactccagggacgcggtctgaaagatcttgatgtcttcacgccgccaacgttcgatgatgaagaagtcgcggagcacactaatctggagacccacttcatcgactccagcggcctgatttcctgggatctgttcaaacaggacgccgattacccgttcacggactggagtttctccggcactaccgaagaagaattcgccacgctgatggccatcttcgctgctgaagataaagaagtttacattgccgattacgagcatctcggcgtatacgcctgtcgtattatcgtaccgggaatgtctgatatttatcctgccgaagatctgtggctggccaacaacaatatgggtagccatcttcgtgagattctgctttcgctgcccggtagcgcctggaataaagaagactatctcaatctgattgaacaattggatgaagaaggttttgacgatttcacccgcgtgcgtgaactgttgggtctggcgaccggagcggacaatggttggtatacactgcgcgtcggcgaattaaaagcaatgctagcgttagcgggcggcgatttggagcaggcgctaatctggacagaatggacgatggagttcaattcgtcggtctttagtccggtacgcgcaaactattaccgttgcctgcaaacgctgctgctcctgtcgcaagaagatgcgcgtcagccgctgcaatatctcaatgcttttataaaaatgtatggcgcagaggctgtagaagccgccagcaccgcgcttagcggtgaagcggctttttatggactaccggctgtcgaccacgatctacaagcgttcccggcgcatcagtccttgttaaaagcgtatgataaattacagcgcgcgaaagcggcatactggtcaaaataaggccatatgagtgacttagggtaggtttaccctctcggctgcgttatattacggggcgcctttgcggccccgttttatttattttcactaaacggcgaaaaatgtaataacaaggttaaatattggttgttgatattaaattaattgacataatgatgttgctttatttgttgattactccatattaattaaccgtgcagcaggaggagccaggaaaaaattcaactctatttataatttttaaaatttatttttattaggataatcaaaaagttacaccgtaattgcataaaagccatgcgacttacgggcctataagccaggcgagatatgatctatatcaaattctcatctataatgctttgttagtatctcgtcgccgacttaataaagagagagttagtgtgaaagctgacaacccttttgaccttttactccctgcagcaatggccaaagtggctgaagaagcaggcgtctataaagcaacgaaacatccgcttaagactttctatctggcgattaccgccggcgtattcatttcaattgcctttgttttttatattactgcgacaaccggtactggcgcgatgccttatggcatggcgaaacttatcgggggtatctgtttctctttgggactgattctctgtgttatttgcggcgctgatcttttcacctctactgttctgatcgttgtagctaaagctagcggtcgcatcacctggggacaactggctaaaaactggttaaacgtctattttggtaacctgattggcgctctgcttttcgtgttactgatgtggctttccggcgagtatatgactgccaacggtcaatggggacttaacgtcctgcaaaccgccgaccacaaaatgcaccacacttttattgaagctgtctgcctcggtattctggcgaacctgatggtttgtctggccgtgtggatgagctactcaggtcgtagcctgatggacaaagcgttcatcatggtactgcccgtcgccatgtttgtcgccagcggttttgagcacagtatcgcaaacatgtttatgattcctatgggtattgtaatacgcgatttcgctacaccggagttttggaccgcggttggttcgtctccggaaagtttttctcacctgaccgtgatgagcttcatcactgataacctgattccggtcacgatcggtaatattatcggcggcggtttgttggtcgggttgacatactgggtcatttacctgcgtggtaacgagcatcattaatctgttgatgtccattacacgcagtaaataaaaaatccacttaagaaggtaggtgttacatgtccgagcttaatgaaaagttagccacagcctgggaaggttttaccaaaggtgactggcagaatgaagtaaacgtccgtgacttcattcagaaaaactacactccgtatgagggtgacgagtccttcctggctggcgctactgacgcgaccaccaagctgtgggacagcgtaatggaaggcgttaaacaggaaaaccgcactcacgcgcctgttgactttgacacctccgttgcttccaccatcacttctcacgacgctggctacatcaacaaagcgcttgagaaaattgttggtctgcagactgaagctccgctgaaacgtgcgattatcccgtttggcggcatcaaaatggttgaaggttcctgcaaagcgtacaatcgcgagctggacccaatgatcaaaaaaatcttcaccgaataccgtaagacccacaaccagggcgtattcgacgtttatactccggacatcctgcgttgccgtaagtccggcgtgctgaccggtctgccggatgcgtatggccgtggccgtatcatcggtgactaccgtcgcgtagcgctgtacggtatcgactacctgatgaaagacaaattcgcgcagtttacgtctctgcaatccgatctggaaaacggcgtaaatctggaagcgactatccgtctgcgtgaagaaatcgctgaacagcaccgcgctctgggtcagatcaaagaaatggcagctaaatacggctgcgatatctctggcccggcgactaacgctcaggaagcaatccagtggacttacttcggttacttggctgcggttaaatctcagaacggcgcagcaatgtccttcggtcgtgtatccaccttcctggatgcgtacatcgaacgtgacctgaaagcaggcaaaatcaccgagcaagacgcacaggaaatgattgaccacctggtcatgaaactgcgtatggttcgcttcctgcgtactccggaatatgatgaactgttctccggcgacccgatttgggcaaccgaatctatcggcggtatgggcgttgatggccgtactctggtcaccaaaaacagcttccgtttcctgaacaccctgtacaccatggggccgtctccggagccgaacatcaccgttctgtggtctgaaaaactgccgctgaacttcaagaagttcgccgctaaagtctccatcgacacctcttctctgcagtacgagaacgatgacctgatgcgtccggacttcaacaacgatgactacgctatcgcatgctgtgtaagcccgatgatcgttggtaaacaaatgcagttcttcggcgcgcgtgcaaacctggcgaaaaccatgctgtacgcaatcaacggcggcgttgatgaaaaactgaaaatgcaggttggtccgaaatccgaaccgatcaaaggcgatgttctgaacttcgacgaagtgatggatcgcatggatcacttcatggactggctggctaaacagtatgtcaccgcactgaacgttatccactacatgcacgacaagtacagctacgaagcctctctgatggcgctgcacgaccgtgacgttatccgcaccatggcgtgtggtatcgcaggtctgtccgttgcggctgactccctgtctgccatcaaatatgcgaaagttaaaccgattcgtgacgaagatggtctggctatcgacttcgaaatcgaaggcgaatacccgcagtttggtaacaacgacgctcgtgtagatgacatggcggttgacctggtagaacgtttcatgaagaaaattcagaaactgaccacctaccgtggcgctatcccgacgcagtctgttctgaccatcacttctaacgttgtgtatggtaagaaaaccggtaacaccccggatggtcgtcgcgctggcgcgccgttcggaccaggtgctaacccgatgcacggtcgtgaccagaaaggcgctgtcgcttctctgacctccgttgctaaactgccgtttgcttacgcgaaagatggtatttcttataccttctctatcgttccgaacgcactgggtaaagacgacgaagttcgtaagactaacctggcaggtctgatggatggttacttccaccacgaagcgtccatcgaaggcggtcagcacctgaacgtcaacgtcatgaaccgtgaaatgctgctggacgcgatggaacatccggaaaaatatccgcagctgaccatccgtgtatctggttacgcagtacgttttaactccctgacgaaagaacagcagcaggacgttattactcgtaccttcacgcagaccatgtaatgggtttgactgaaattacgccataaaaagcgtacaaaaaaggctccatatcagtggggcctttttaatgactttttatataagcatattgcgacaactagaattttcacttataaataaagtgttatcatgtgatctatatattcttcttagaatagaatcaatttctcttttattattttgatactcatcataatccttatttaatacatcagaaaacagcatggtgttagtttctattaaatcagataacaatgacggtttatatgcgtgtagcagatagataagtgttggatgaaccatatcaaacaggacttctccctctaattcccagtaacctattttacaaaattgggtagtaatattaaaagaccccatttgaagacagcgtagtttattcatctcctcttcagtaagcgtaccattccattcaacacattccatttttcgatcttctccagatcgcataaaattataaacttcatccttaatgtcatcatcctcattaactgcatctttaagtttattagcaaagccttctaataattctggatagcgagcaattttttctccatacttaatacatactttaaaaaacaactctacttcatcgtcttccatcactctaaaaatacagttttctgaaacgttgaggagacgatgcaaattacatttatcaataacctggccatcaatctcaaataaaacttttgtctgattcatatcaaaacgcataacaaagcgctcttgttgagatggattagcatattgttttaattgtgtaaaggcatgtatcttctccatgccggttatatcaacattaagttcagcttgattttcacgttcacatccatggatgagtgtatataatacctccagcacctcttttttttgtgtgttctgaagcagtccttaaatctatcccatacccccatgtatagcgcttcttctttattaggactcatcaaacgggttagccgtgaagtattaacttcatagttatgacgattaccaaaacttaacgtaactggcataataactcctttgattatttaccgcgaaagcaaaatccaatccgttgctctcattttttgattaaaaccacactctatttaagagattgaatcagtccgggtttagaaatgacatcagatttacacctgattgcgcgttgaatgcaacgccaggcactggacaggcgtaacgttctttggacacatctgaattatgttgagaattatttttgttctgaccacaaaaacggcatcaaccatttgaaaaaagaggcggttcataaacagcaaaaccaggacgctatggatgatacacttacagtatgtattgcggttcgggcgttacgagctgatgaatgagccacaatttctggcggtgcaagctatgcagcatagatttgccgtatattttatactgaatagaggtaaaatagctccattgcagcacattctggaacagccacacattctgtagtccaaaatttacgctcgcagtaccgcttttttacaggatgcaacccccttactagggtgctcaacatgcccggaatgtgtccataaaccccatgttatttagagctagccgaagcgatatgagtaacttaaccgattgtattacaaatgaaagtgttgcagtaactgctgataaaaagccggttattggtcgcattcactcctttgagtcctgtggcaccgttgatggcccaggcatccgctttattacctttttccagggctgcctgatgcgctgcctgtattgccataaccgcgacacatgggatacgcatggcggtaaagaaatcaccgttgaagacttaatgaaagaggtggtgacctatcggcattttatgaatgcttctggcggcggcgtgacggcatccggcggcgaggccattttgcaggcagaatttgtacgcgactggtttcgcgcctgtaaaaaagaaggtatccacacctgtctcgacaccaacggctttgtgcgccgttatgacccggtgattgatgaactgttggacgttaccgatctggtgatgctcgatctcaagcagatgaatgatgagatccaccagaatctggtcggtgtatccaatcaccggacgctggaattcgcgcagtatttatcaaagaaaaatgtgaaggtctggatccgttacgttgtcgttcccggctggtctgacgacgatgattccgcgcatcgcctgggtgagtttacccgcgatatgggtaatgtcgaaaaaatcgaactgctgccctatcatgagctgggcaaacataaatgggtggcaatgggcgaagaatataaactggatggcgtgaagccgcctaaaaaagagaccatggaacgtgtaaagggtattcttgagcagtatggtcataaagtgatgtattaatcgcctgctatcttatccgcttttaaacggctacccatgacggtagccgttttgctgtctgggtaacgctcttaccgctaaaatacccgaccccgccgtcagacaggcctggttaacaatattgcgcttaccaggtattaaatacagagtcgcttatctgctgctgggttgaaggtctgacaactattgctgccccggcgcctgttaataccgtggtctccgcctggaacccaggcacctgtaaccttaaaaggcgctcgcctgacaggagcgccgtggaaaagagcgtcgttatgtgtttctacgcgccagcagtgggaaaattaatcccaacccgaccaggacaaaaggtgtcacgatgttcaacgtcagctggaatgcccactccggcgtgaacgcctccattttggggaaaataccggtaaggcaggcaaacgcggtgaaggcaaaacaccatattcccacagttaacgccaacgcccggttgcgaataaacacatattcgggtttgtacttttgcgccagtcgaatgacggcaataaaggcgacaaatacccacagatagcgcagcggcataacgactgaattgagattaagcagccatttgtacaggttgttcatatcgccgatgccaagcgttggcaacataatcaagatagcgaccaacactaatgtcagcaaataaccgttaactggtgtacctgaagcgttagtacgacataagcgctgcgggatatatttactgtctgcatcacccagtaagactttcagtggcgcatcaatagaaaacaccagcgcggcgatttgccccagagtattggcaatggcataaatcaccattaatgaattacccatatggtaatactcacccaatttctggaatgcataatattgcccattggtcattaaatcgtcaggtatatgccgggaatcaaacatcattcccatcgccaacgaaccgaggatagcgcagaccgcaaccatgacggctaaaaagagcatccccttcggaaattcttttcctggattccgcgtctggttgacataaggcgagatcttctctgccccaccaaccgcaaagaccaacatagagatggtggtgatataggtaaaatcgatatgaggaataaatgactgccaggtgatgttagcggtcgcaatttcaacgtttgtaattgctggcgcggtcactgccatcacaacatataaaattgacatgataaacatggcaatcccagccacagacccaacaacctttagcgatttcatcccccgggaagcaacccacataaagaaaacaaacaatgccagcgtcagcccctgcaaggcaacgacggtatattcttttatcaacgagccgtcgccttttaaagcccatcccaatgcaatgagtatcgcctgcggcttttgcgccaggtagggaatatgcacgacccaataagtccatgccgcaaggtaagccaaccccggccccatcgtatgcttaatccaggtactgacgcccccttttccctctttgaaggttgagcccagttgccccacgattaaggcataaggaataaaatagagcgcaaaaataaacacccaggagaagacaaccactaacccctggttagcatagttattgacaacattgccgaatccccaaacggtaataaacgacatcagggcgatgttgtaccatcgcaactgtttttcctgcacattcggcataacgcgatccttcgtgaacacaatgctattactataaatgaagcgggggattatgcgcggtaaagacgaagagagaaaatagaggagcgcaaaattataaccttcggcacattttatttttcagtaaagcaagaaaattatgcaggtcaattattttacgtaaaacataaacaaagagtatgcaagactcacgtcctgcatacgattcagagaacagttagatgtgggcgacaggattaggcgtctggccgacgttacgtaacagcatcagcagataaataaacgatacgctggcgatcataataaacagcagattatctgaataattctgcattaacatcgcagcaaaagacggccccaacaggctccctaccgtataacttaacaacagcgcctggttcattgccacaagctggtggtgttcgactttttcacaggcccaggccattgcaacgggataaagcgtaaaacccgccgcccccagaataaacagagctggcgccatcgccgcctgggttaacatggcaatactgccgagtatgacaacgaatacctgtacgcgtaataccagcaagcgaccaaatttgtccgccagacgtcccattggccattgccccaaaataccggcgctcaccagcaccgccatccagaaaccgatgctggcgttagccatcccctgatgcttcagatataacggcatcaggccatataatgaaccaagaacaatgccggaaataatacaaccattcacgccaagacgcgcctggcgtagcttcagcatggcgctaatagaagaggaatgacgtgcctgcgtttgctgatttacaattcgggtaaagagtagcggcagaattcccgccagaatcattccggtcacccagggaaggacgtgcagcaattcaccagatactttactgaccaataattgtccaaggaaggtccccatgtaatagaccatcatataggcagccagcaggcgtccgcgattatgcgaggttccgctgcacatcaacgcgctttcgacaaccacccaaatcatggcgcagccgataccggcaataaaacgccagctcatccagctccagaaccccaccatcacccccaacccgacacaacccgcggcgaagatcagcgaggcaagataatagctacggttaaacccaatgcgtttaattaaatacccggtaaataacgtcccgaccagattgccggtaaaataagacgagctgaccatccccacctgccaggtcggaaggtttgcctgagcaagccacagcggcacaagcgtattcagtaccgcaatggccagggtcaacaaaagtagcccgcacagcaaaagcatgacgggacgggtatagatggacatgaataaaaaccgtgaggaagttcaaatttcatgcgcatcatgccatcgccaaaaacattgtcaatcggctccgcatgggcgatccgcaagttttgagactatcgattcgatttacttattctgcacgtgaatatattgaaaggctaaaaattcatccccttgtttttattgatctaacccgcaaaatcggcgttttgttcagtcgaaaaatttcatggttcctttagcttcgttttcttctctatggatttatatgcgccttctccgccccggttatattccttagattgacggcggctaaaggcgtattcggcctgcacgttctgcaggccgaatgcgcgtcaacgcgttagctggctaccgccatgcccacggtcatatgcagcccatagaatacgccgcggccaatcaattcccccgccagcatcagaatgaaggcgacagagagtaacggtaccgcaggttgatacccttttaactgtggcacaatccagcagcacaacgccgccgcaagcagcaccatacgccaggccatcagcgaaccataatccggcaccagagcagacgcctgctgaatggaactgtgaatcgtcgccagttccgcgccctgcatggccaccataatggcaataaccaccagcgccagcaccgaaaccgcaggcaacagacgcatcgcccaaccgttcacgcccgcgatgcgcagcagcagataacccagtagcgggccacccataaagagcgtcaggaagaagcccagcggcgtccagacgctataccaggtcggtactgtatcgatgctgttatagacgcgtaccatcatccagacgaagacgacgcccagtaccatcgtgataatcagccagagtgtgcgcagtgccggcggcagctttttcagtaccgccagcagccagccgatcccgccgaccgcaaaaaacaccgagccgctggcaatttcattgctcagtgcggaagcacccacgcggttaagcgagttaaacgcgcgcatcggcgagcccagatgcagcatcgaggcgataaagccaatccccatcagcacccacagaccaaacatacaggcgatcacccgctgctgcgtttccgcgcgcaggtcgcccttcatcagcgccagagccagaacaataaaaccaccggccacgcactgaccaaagaccgtgaagatcatcaacggccattcatgccatccacttcccatcttatacctccttcggattggccagataaccggtggtgtccccggtcgggcggctgttggcgttgggtttaatcacaatattcggcttcgtgaaatgcgcgcgcggcaacggcgcgacggcagccagctcaccgtgttttttgcgcagttcgtctatcgggccgaaatccagcgcccgcagcggacaggattcgacgcagatcggtttcttaccttccgccacccggtcataacagccatcgcacttggtcatatgacctttggccgcgttgtactgcggcgcgccgtacgggcaggccatgtggcagtagcggcaaccgatacagacctcttcgttcaccaccacaaaaccgtcatcgcgcttgtgcatcgcgccgctcgggcagactttggtgcaggccgggtcttcgcagtggttacaggagatggagagatagtaggcaaagacgttctggtgccagacgccgttatcctcctgccagtcgccacctgcatactcataaatgcggcggaagctgacatccggggtcaaatctttgtagtccttgcaggccagttcgcaggttttgcaaccggtgcaacggctggaatcaataaaaaatccatactgggttgtcatcggttactccttacgccttttcaacctgaacgaggttcgtatgtgacgggttccccttcgccagcggagaaggacgttgactggtcagtacgttaatacatccgccctgatccacgcgttttgcatccgggtcataccatgcgccttctcccagagcgaccacgcccggcatcatgcgcggcgtcactttagcctcgatatgaacttcgccgcgatcgttgaagatgcggactttatcgccattgttgataccgcgtttctgcgcatccattgggttaatccacatttcctggcgacaggcggctttcagtacgtctacgttgccataagtggaatgcacacgcgctttatagtggaaacccgtcaactgcagcgggaatttatccgttagcggatcgttatagttttcaaaacctagcgtgtagatcggtaatggatcgatcacgtcgccttccggcagctcccaggtggcggcgatatccgccaacgcctgtgaatagatttcaatcttgcccgatggcgttgtaagtggattcgcttgcggatcttcgcggaagtctttataggcgacatggtggccttcggggtcgcgctgtttgaagatgccttgcttacggaactcctcaaaggtgggcagattcggaatggatttacgcgactgttcgtacagatgacgcatccactcttcttgcgtccggccttcggtaaactgttgttccacgccaagacgtttcgccagttcgctggtcatctcataaatcgtcttacactcgaagcgcggtttaatcgcctggtcagtgaagataacgtaagacatgttcccgcaggaggcatccagcgcaaagtccatctgctcagaagcagtgcaatcaggcaacagaatatcggcgtattttgccgacgaggtcatatgacagtcgataacgacgatcatttcacatttactgtcatcctgcaggatttcgtgggtgcggttaatctcagagtgctggttaatcaaacagttgccagcatagttccagatcattttgatcggcacgtccagcttatctttcccccgcacgccatcacgcagcgctgtcatttccgggccgcgttcaatggcatcggtccacataaacatggagatgctggtttcaaccggattttccaacgtgggcatacgttcaaatggcagggcataagacccttcgcgcgcgccgctgttaccgccgttaatcccaacattacccgtcaggatcgccagcatcgagatggcgcgcgtggcgatttctccattagcatgacgttgtggcccccacccctggcaaatataggcgggtttagcgctgccgatttctcgcgccagtttaataatgcgatctgccggaataccggtaatttgcgccgcccactccggcgtctttgcgataccgtctttacccaagcccagaatataggctttgtagtgaccgtttttcggcgcgctggcaggcaaggttttttcgtcataaccgacgcaatatttatccaggaacggctgatcgaccatgttctcggtgattaagacatatgccagaccattgaccagcgccgcatcggtacctggacgaatcggaatccactcatcttcgcgaccggcgccggtgtcggtgtaacgaggatcgataatgatcatccgcgcgtttgatttctgccgcgcctgttcaagataatacgttccaccgcccccgctcatgcgggtttcgccagggttattaccaaacaacaccaccagcttactgttttcaatgtcggatggactattgccatccgcccagccgccataggtgtaattcagacccgctgcgatttgcgcggaagagtaatcaccgtagtgattaagataaccgccgcagcagttcatcagacgagcgaccagcgtttttcccggcggccatgaacgtgtcaaagtgccgcccagcgttcccgtgccatagttcagataaatggactcgttgccatactctttgataagacgctgcatattggtggcaatgatatcgtaggcttcgtcccagctaatacgctcaaatttaccttcgccgcgcgcgccgacgcgcttcatcggatacttgagacgatccgggttatagacgcgacgacgcatagaacgaccgcgcaggcaggcgcgaacctggtgcaggccatcgtaatcatcgtttccggtattatccgtttctacatatttgatttcgccatccacaacatgcatacgtagcggacaacggctgccacagtttaccgtacaggcgctccagacgactttctcgtcggttttcgtcgggcttatcgcctctgcggcgttagcgatgcgggtaaatggcagggtaaatgcgctactggccatcgccaggccgcctatcgcggtggttttgactaaaccacgacggctcacctcggctgccagcacggcatcagggatcttagttttcataagggctcactctgctgctcacaataaaaaagcaataaaacgatgtatagaattttatatagcgataacgtcgctataaagtctgatatatatcgaaaaagtagaaaaatagcgttaaaaactgaccttcattcgaaatcagtattacccctaatagggtagggattattgtccggtatcaaactggcataaaaaaagcgcccgcaggcgctttttagaagaggagaaagcgaggattagccgatatattccagtccgttcatgtacggacgtaatacttccggcacttcaatacgaccatcagcctgctgatagttttccatcacagccaccagggtacgacctaccgccagaccagaaccattcagggtatggaccagacgggtctttttgtcggacttgctgcgacagcgtgcctgcatacgacgcgcctggaagtcccagacgttagagcaggaagagatctcgcggtaggtattctgcgccggaacccagacttcgaggtcataagttttgcaggcgccgaagcccatatcgccagtgcacagaatgattttacggtacggcagtcccagtagctggagcactttttccgcgtggccggtcatctcttccaacgcagccatagaatcttccgggcgaacgatctgcaccatctcaactttgtcaaactgatgcatacgaatcaggccgcgggtatcacgaccataagaacctgcttcagaacggaaacaaggcgtatgcgccgtcattttaatcggcagctgatcttcgtcgatgatttcatcgcgtaccagattggtcagcggaacctccgccgtcgggatcaaagcatagttactgctgtctgcttcttcttccagcggacgggtatggaacaagtcgcctgcgaatttcggcagttgaccggtgccatacagcgtgtcgtggttaaccagatacggcacgtagttttcgctatagccgtgctgttccgtatgcagatccaacatgaactgcgacaatgcgcgatgcatacgcgcaatctgtcctttcatcaccacaaagcgggagccggtcagcttaaccgcagcggcaaagtcgaggccggagtgcatttcccctaaggtgacgtgatcgcggatttcaaaatcaaactcacgcggggtaccccagcggctgacttcaacgttgtcgttttcatctttacctaccggcacttcatccgcaggcaggtttgggatggtcagcgcgatatcgcggatctccgccagcaaggtatccagctcggctttcgccgcatccaactcttcgcccagtttattcacttccaggcgtaaaggctcgatatcttccccgcgcgctttcgcctggccgatggatttcgatcgagaattacgctccgcctgcaggttttccgtgttgacctgcaaaactttacgacgctcttcaagagcgcgcagcttatctacatccagcttaaagccccggcgtgccagtttttcagcgactgcgtctggctcattacgcagcagattgggatcgagcatgcttatcctgtgcttatcgaataataaaaggaaacgcgatcaattgatgatcgcctctgattgtattgatgaacgtaaaccccgtttacgtaatagcgacgttttcgccttacctgaccgacgacagcaacaacgcatccattgcgctatacccgcggacctcataagcaacgtgctatcaggcataacgaggttcatcatcaacgccatgatacctggagcatcatatttagagataaccttaccgcaacgtttacactagcggtagcgttttgtggggctattttgatcctgttcagccagccaggcgagcttttcgccaatcttaccttccagaccacgatttgtcggatgataatagcgcgtttgcgcgatttccggcgggaagtacacttcacccgcagcataggcattgggctcatcgtgggcatagcggtattcctggccatagcccatctctttcatcagtttggttggcgcattacgcagatggacaggaacgtcataatcaggacgttcgcgcgcgtcggccagcgcagccttaaaggcggtatagacggcgttgctcttcggcgcgcaggcgagataaacgatagcctgcgcgatcgccctttcgccttcagccgggccgacgcgggtgaaacaatcccacgcggcaatggcgacctgcatcgcgcgaggatcggcattacccacatcttccgaggcaatcgccaggcagcgacgcgccacgtacagcggatcgcctcccgcggtaatgatacgggcataccaatagagggcggcatccggcgcgctgccgcgcactgatttatgtaaggcggaaataagatcgtagaagcgatcgcctttgttatcaaaacgcgcgctgcgctcgccggcgatctcggtcaacaaggcgggcaataaaacgcgtttgccgctgtcatccgcctccgccatatcagccatcatttccagcgtatttaaggcgcgccgcgcgtcgccattgaccagctcagcaatcgctcgccgtgtctcatccggtaacacgatatcctgatcgccgtaaccacgcgttttgtcctgcatcgcctggtccagtacttgctcaatatcgtcagtagtcaacgatttcagcagatagactcgcgctcgcgacaatagcgccgagttcagctcaaaagagggattttccgtggtcgcgccgataaaggtgatagtgccatcttcgatatgcggtaaaaaggcgtcctgctggcttttgttaaagcgatgcacttcatcgacaaacaggatggtacggcgaccggcattacgattctggcgggcgcgctcgatagcttcgcgaatctcttttaccccagaagtgacggcggaaatacgctcgacatcggcgctggcgtagcgggcgatcacttcagcgagcgtggttttccccgtccctggcggcccccataaaatcatggagtgcagatgcccggcctcaatagcgcgaggcaacggcttacctgcggccagcaaatgctgctggccgatatactgtgctaaattttccggccgcattcgcgcggccagcggttgaaacgtattatcagaaaaatcgagcgacagattgctcactcatcgcctctacttacgttggtcgtctatcgttaccccttgcggcggagtaaacgtaaattttgacggttcaacagcgccgttttgctgggattttagctgataggcgctacgctgatcgtcttgttctacggcgctaaactggtggatagtcccgtcgcgtcccacattgatggtgaactgtttcagattgccgttgctggctttcggcgtcagcacaaaattatcgccatcctgcttaatattatactgctgccagtcgctggcctggttgcgggcaatcagcataaacggtgtatttccggtggcatctttcaaccacgtggcggtagcctgttctacaaacgggttatagaaccataacgttttgccgtcagaaaccagaatactctcgtcaggttgcgtcatatgccagttgaatagatttggccgcttaacccataaatcaccctgtccctcctgcaccgcggcaccgctgccatcggtgactttttgagtaaaggtggcatgaaagctgctcactttatccagacggcttttcagagagctggcggcgtcagcccatacgctgctggctacaacgcttgaaagtaatgcacaggcgattgccatttttttcatcattattcctcaagtttcgacactcccgaccaggagctccttttgctttctattccaggccaaaaatcagcatgaggaaagaagaaaatactgaattttgttgccggatggcagcctctgaacagcgccatccggtttacaggtttactcaaaaggcggcggagccaacacttcgcgattaccgttatgcccctgagcgctgacaataccctgcgcttccatctgttcgataatacgcgccgcacggttatagccgatacggaactgacgctgaacgccggaaatggacgcttttcgcttctgagtgacgaaattaacggcctgatcgaatagcgcatctaattcttcgccgccgtcaaaaccgccaccgccaccttcgctttcgctgtcggaggtaatgccatccacatattgcggacgaccgcgcgctttccagtcctgcaccaccgcatggacttcctggtcacgcacaaacgccccatggacacgtaccggcatggtggagtttggtccggaatagagcatgtcccccattcccaataacgactcagcgccaccctgatcaagaatggtgcgggagtcgatcttgctggatactgtaaaagcgatacgggttggaatgttggctttaattaaaccagtaatcacatcgaccgacggacgctgcgtcgccagtaccaggtgaatccccgcagcgcgcgctttctgcgccaaacgcgcgatcagctcttcaacttttttaccgacggtcatcatcaggtcggcaaattcatcaaccagtaccacgatatacggcagtttttccagaaccggatgctgaacatccatactgtcgcccggcttccagtacgggtccggaatcggacgtcccatgcgggccgcttcggcgattttctcgttataaccagccagattacgcacgccgagcgcggacatcagcttatagcgacgctccatctcattgacgctccagcgtaacgcgttagctgcatctttcatatcggtaacaacttccgtcagcagatgcggtataccttcatagaccgagagttctaacattttcgggtcgatcatgataaagcgaacgtcttccggctgcgctttatacagcatactgaggatcatggcgttaaccccgaccgacttaccggaaccggtcgtaccggccaccagcaggtgaggcattttcgccagatccgccactaccggatcgcccgcgatatccttacctaacaccacggtaagcggcgacggattctcgcggaatttggcgttatccaacacttcgcgcagataaacggtttgccgtttcttgttcggcaattccaaccctacgtaaggtttgcctggaatgacttccacaacgcgtacggctaccgttgacaaggagcgcgccagatcccgggaaaggttggagatacgcgctgctttaacgcccggggccagattcagttcaaagcgagtaatgaccgggcctggcgaatagttcaccacatcagctttaatgcggaaatccgccagacgcgcttcaaccagacgcgccatttgttccagcgcaaaggtatctaccggttcaacttcgctcggcggcggcgtcagaagatctaatgaaggcagcggcgtcgtcggacgctgcaatggacgactgtcgccgttacgcatcaacagcgggtggatcagactgtcttgcggcgctgtcggttgctgcggctgctggtactgcggctgaggcgctaccggctgttgcggctgctgatactgtggctgcggcgctaccggctgttgcggttgctgatactgcggctgcggcgctaccggctgttgcggctgctgatactgcggctgcggcgctaccggctgctgcggctgctgatactgcggctgaggcgctaccggctgttgcggctgctgatactgtggctgcgacgctaccggctgctgcggctgctgatactgtggctgcggcgctaccggctgctgatactgcggctgcggcgctacaggttgctgaacaggcgttgactcgggcatgacacccggcgtgaacagcggttcgtgcggaccttcatcaaccaatactttcattggcgagaaatccagatcgtccagtgagaacggctgcgcgccagcgggttgctcgccggaatagcgctgctgttgcgaagcggcaaactggcgggctaattcagcttccgcagcggtatcgtcatcttctgcctgttgagtatcatgctgatacgtctcaccataacgatgctgctgcgactgcgcaaactgacgggctaactcgtcctgatgcattgcatctatttcttcatcggttagctgcgcgcccgtctcgtactgattgcgctccgcctcgcgggctttttcttcagcaatcctctgtgacggcagcttaataccgtacgatgccagttcccgtcgggtcggcacgcgaacgcggttcggacgcggcagttgcggaccaatcccctctttcacctgcggacgcggcgcgccgccggtagccagactaaatgcaggcgcagcggccgcggcgcctgctgccagggcgccactcttaatacctgtgtcaagcgacgcggcggcggctaccgcttccactggcggtatggacggcgcgacagataccgtaggtttgaccggcacgttctcttttaccggctccggaatcggttgataccatgccgccagttgttcgcgctcacgggcgcgtttctcttccacctcttcaaaatagtaaagcggagggcgagcgggcctggtctcttctatgccaggttcaggctcggtggcaaccggctgttcgataaccggcggcggcatgtgggaaggttcagccgctatcggctccggctgccagtgttgttcggcatccggcgcctgccattgcggctgtgtttcctgcggcgcaagagagtcatattctgctgcggtcgctggcgtcgcggcgtattgcggcgcggaagcgacaggcacaggttgctgccacggcgcactttgcgcctcctgcggttgagcatattgcggatgcggctgatacccctccggcgcaggcgcgataaccggttcgccggtttgcggccccggtacgggctgccactccacggtcggttgcgcgacaaccggctcagcccccggcatgggcggcgtttgcattatgggatcggcggacgctgcccacgtctgggtgacggcagttgcggccgcagcggcggcgaccggttcggtgacagaatggccgtttaacagcggatcatattcatcatattccgactgcgtcgcacggttgcccgaaaacagaacgtcgtcgggatcggcagcgacgccgcgcgcgctatactgaatgtcctcgtcatcatccatccgtttgccggaaaagagcgcggcatcggtctgacggccccgtggattgctgaatttttcagccagtcgcttacgacgcgccaacgcgccgcgcaaaatacgcgcccggcgagattcacgctgcacgccatcggtttcttcatcgtattcgtcatcatactcttcgtcgtcaacccacgtatcatcacgccgggtacggttgctggcgaaggtcagtatattaagcagccagccgcctaatttttcggcgatactaacccaggaccagccggtaaagagcgtcagcccggcagcccaaatacagagaagcattatcgttccgccgctactatgcaacaacggctgcagcgtggtgcttaacaggctgccaattacgccgccggaggcgaaataccagatatcgtcggcattaatggccgccagaccgcaggaagtgagaatcagcgccagcacgccaataaggcgtagcgacacagcaaaatagtcgatgtaatcatccgtagactgatgacgccacgcaaaccaacacccgccgacaataatgacagggatagtgtaggccattacgccaaaaataaagaacagtgtatcggccagccacgcgcccggcgcgccgcctaaattatggatgggttcatgccaggcggtttgcgaccaactggggtccgaagggttaaagctcaacaaggccgccatcaaccagacggcaaaaagggcaataagtatcaacaacgcttccagaagtcggcgcccgctgcttaacttcgtcaatgtgacgtctttgtcttcagtatattcctggctcaaaaaaggctctccaggttccaggcttttcccgcccgatgctaaaacggacaacagcaccgggttgccccggcactgttgctgtatggattaacaggagtgtaatcaaactacggcgattttgcacctgttccgtgttagcgtgtcttaataaccagacgattactctgttttacctcttccatcactacgtaagttcgggtgtcgttcacacctggcaagcgcagcaacgtctctcccaatagttttcgatacgctgacatatccggtacacgggttttcaacaggtagtcgaaatcgccggaaaccaaatgacactcctgaatctcttcaagctttttcacggcggcattaaactgttcaaacacatccggcgcgccgcgatttaaggtaatctcaacgaataccagaagtgacgcatccagataatgcgggttcaacagcgccgtatagccctggataaacccctgtcgctccagccgacgcacacgctcaaggcaaggtgtcggcgaaagtcctactcgtttagaaagctcgacgttggaaatacgcccatccttttgcagttcattaagaatgttacgatcgatacggtcgagatctttgccagggcgcttcttgctatctaccattattattgtctctctgtattccttccctactcctgcctgactctactcacatcactgttcagagtcgctgcccatcacaatagaccgaaacccagagggattaacggcgtgcaatgcctggtctatggtgagaagaccgttgcctcgcggcagctatcgacatcacgaatggcgtctgtccacgccatgcgtagatttcactagcccggtaaacatggtatttacatgcatgattatgcagcacatacataacacagtttttttcttcctcgaatgttttcgcaaaacagcaggtgattgtcaaagcaaaacatcgatttttagtacaacatgccagttattcattagagagggcggtaaactgtcatttcgtcaccttataagttaccgattttaattaaagtttgtgatgataacgtcgctgccgcggtcgttcatcggttcatgctattacacatattgttaacaaaatcgttatgctctttttttacgtctgtaaattctctacaattctgctcattgtctgccaacaactatggggatctcatgggcacgaccaaacacagtaagctgcttattctgggctcaggaccggcgggatataccgcggcggtgtatgccgcgcgcgcaaatttacagccagtacttattaccggtatggaaaaaggcggtcaactgactaccacgacggaagtggaaaactggcccggcgatccaaacgatttgaccggcccgctgctgatggaacgcatgcatgaacatgcggcaaaatttgaaaccgagataatttttgatcacatcaacaacgtggatctgcaaaatcgtccgttccgtctgacaggtgacagcgcagagtacacttgtgatgcgttgatcattgcgaccggcgcttccgcgcgctatctggggctgccatcggaagaagcctttaaagggcgcggcgtttccgcctgcgcaacctgcgacggtttcttctaccgcaatcagaaagtggcggtgatcggcggcggcaacaccgcagttgaagaagcgctttatctgtccaacatcgcttcggaagtgcaccttatccatcgccgtgacggtttccgcgctgaaaaaatcctcattaagcgcctgatggataaagtcgaaaatggcaatatcatcctgcacaccaaccggacgctggaagaagtgaccggcgatcagatgggcgttactggtctgcgtcttcgcgacacgcagcagagcgataatatcgagacgctggacatcgccggacttttcgtagccatcggtcatagcccaaacacggcactcttcgaaggccagcttgagctggaaaatggttatatcaaagttcagtccggcacccatggcaacgccacacaaaccagcatccctggcgtattcgcggcgggtgacgttatggatcatatttaccgtcaggcgatcacctctgcaggtacgggctgtatggcggcgctggatgccgaacgctatctcgatggtctggccgacgcgagcaaatagtttttacaaatcagtaacaaaagtaaaaaaggcgactataagtcgcctttatttttgcgtcgttgtaacattgccctgcctgaaattccaataactcacctgctaagcgtgcaatgaataaaacccgtcaaaaagagctgacccgctggttaaaacagcaaagcgtaatctcccaacggtggttgaatatttcccgcctgttggggttcatgagtggcgtattaattgtcgctcaggcctggatcatggcgcgtatcctgcaacatatgatcatggagaacattccacgggaagcgctgttgctcccttttatcctgctgatactgatctttgtcctccgcgcctgggtggtgtggttgcgcgagcgcgtcggttttcatgccggacagcatattcgctttgagatccgccgtcaggtgttggatcgtctgcagcaagccggcccagcctggattcagggcaagcccgccggtagctgggcgacgctggtgttggagcagattgacgatatgcatgactattatgcgcgctatctgccgcaaatggcgcttgccgtttgcgtaccgctcttaatcgtggcggcgattttcccgtcaaactgggcggcggcgctgattctgctgggcactgccccgctcattcccctatttatggcgatggtggggatgggcgcggctgacgccaaccgccgcaatttcctggcgcttgcccggctaagcggccattttcttgaccgtctgcgcgggatggaaacgctgcgaattttcggtcgtggagaagcggaaaccgagagcattcgcgcagcatcgcaggattttcgtcagcgcacgatggaagtactgcgcctcgcctttttatcttccggcgtgctggaatttttcacctcgctttctattgcgctggtcgccgtttattttggcttctcttacctgggcgagctgaactttggtcattacggtaccggtgtgacgctcgccgccgggttcctcgccttgatcctcgcgccggagtttttccagccattacgcgacctcggcacgttttatcatgctaaggcgcaggcggttggcgcggcggatagtctgaagacatttctggaaacaccccttgcccacccggcgcgcggcgaagttgagctggcggaaaacgaacctgtaaccattgacgcagtcaatcttattatcacctcgccagaaggcaaaacgcttgccgggccgctgaatttctcattagcggcaggagaacgcgccgtcctggtaggacgcagcggttccggtaaaagctctctgttgaatgtattatccggttttctctcctatcagggatctttgcgtattaatggtgtcgaacttcgcgatctctcgccggaatcctggcgccagcatctctcctgggtcggacaaaacccgcaattacctgcggcgacgctacgcgaaaatgtattactggcgcgcccggacgccagcgagcaggaactttatgccgcgcttgacgccgcatgggtaagcgaatttttaccgctgctgccgcagggagtagacaccccgctcggcaatcatgccagcagactttccgtcggccaggcacagcgtgtagcggtcgcccgcgcgctacttaatccctctcaactgctactgctggatgaaccggcggcaagcctggacgctcacagcgagcaacgcgtcatgcaggcattaaaagcggcgtcaaaacgccagaccacattaatggtgacgcatcagttggaagatctcgccgactgggacgctatctgggttatgcaagatggcgcgattgtcgaacaaggcagctatgccgaactcagcgccgccaacggcgcttttgcgacgttattggctcaccgtcaggaggatatttaaatgcgcgcgctactcccttatctgacgctttataaacgccacaaatggatgctaacgctgggaattgcgctggcaatcctgaccctgcttgccagtatcgggctgctgacgctttccggctggttcctgtccgcgtccgctatcgcaggcttcgcgggaatttacagttttaactatatgctcccggcggccggcgtgcgcggcgcggccattacccgtaccgctggtcgttattttgaacgtctggtaagtcatgacgccacgttccgcgtgctgcaacatctgcgtatttataccttcagcaaacttctaccgctctcccccgcgggtctggcgcgatatcagcaaggtgaactgctgaaccgcatcgttgccgacgtcgacacgctggatcatctctatttgcgcgtcatctccccgctggtcggtgcttttgtagtgattatgattgtcaccctggggcttagcgttctcgacgtgacgctggcgatcacgctgggcggcattatgctgttgacgctgtttattatgccgccggtgttttatcgcgccggcaaaaataccagccaaaatctgacgcatctacgcggtcagtatcgccagcagctcacgtcatggttacagggccaggcggaactcaccatttttggcgccagcaaacgctatcgggcgcaaatggaagccaccgaattacaatggcatgaggcccaacgccgacagtctgaactcaccgccttatcgcaggcgttaatgctgctgattggcgcgctggcggtgatgttaatgttgtggatggcctccggcggcgttggcggcaatatgcagcccggcgcgctcatcgcgctgtttgtcttctgcgcgctggcggctttcgaggcgcttgcgcccgttaccggcgcattccaacatctggggcaggttatcgcctctgcgcttcgtatcactgaattaacggagcaaaaaccggaggtgacctttccacaggcagaaactcccgcgccggaaaaggtcacactcaccctgcgggacgtttcgtttcgttatcccgaccagccgattaatgcgctcaatgccctctcattacaggctaatcctggcgagcatgtcgctattctggggcgtaccggctgcggaaaatcaacgctgttgcagctactcacccgcgcctgggacccgcaacaaggcgaaattctgctcaacgatcttccgctatcctcgctgagcgaatccgccttacgccggactatcagcgtggtgccgcagcgtgtccacctgttcagcgccacgctgcgtgataatttattactggcggcgcccaatgccagcgacgaagccctttccgacatgctgcgtcgcgtcggcctcgaaaatctgctcgaagatagtgggcttaatagctggctcggcgaaggcggtcgtctgctatccggcggcgaacttcgtcgcctggccatcgcccgcgcgctgttgcacgatgccccgttgatgctgttggatgagcctactgaggggctggatgcgaccaccgagagcgaaatgctggaattacttgccgatgtgatgcgcgaaaaaaccgtcctgatagtgactcaccgtttgcgcggcctggcccgttttgatcaaatcatcgtaatggacgacgggcgcatcattgagcgaggcactcatgcagaattgttagccggacaagggcgctattatcagtttaaacaacgtctgtaagctattattgaacgatccgacttgcgtactggagtttcgccgtcatgcgtctggttcagctttcccgacattctatcgccttcccttcgccggaaggcgctttacgcgagcctaacggtttactggcactgggcggcgatctcagccctgcccggttgttaatggcctaccagcacgggattttcccgtggttttcgccgggcgacccgattctgtggtggtcgcccgatccgcgcgccgtgctgtggcctgaaaagtttcacctcagtcgcagcatgaagcgctttcacaacgcatccccttaccgcgtgacgctcaattacgctttcgaccgggtcattgatggatgcgccaatcaccgtgacgaaggcacctggataacgcgtggtattgaggaagcctatcgccgattacatgaattgggccacgcgcactccattgaagtgtggcgcgatcgggaactggtcggcgggatgtatggcgtctcgcagggggcgctattttgcggcgaatcgatgtttagccgccaggagaatgcctctaaaaccgcactgctggttttttgcgctgaatttacccgccacggcggtaaacttattgattgtcaggtacttaatagtcataccgcctcgctcggtgccattgaaattccacgtcgtgactacctcgatcacctcgcggccttacgccaacagccgctggcctcccgtttttgggtgccgcggacattatttttgccccggaagtgaatgttttcggcacattttttattggggtgttataattgctgccgcagaattggtttagctcattatcacgcagcccgttgtcaggtaacgcccatcgtttatttcaccgttcccttatatgttgcgcttatgtcgatacatcaggcggtagtatcagggaaaaggtgtataacgcggcgttgtcgtgtgtcgcggaatcatgtgctaaacctggtttgctgtgttttaaacgcacaaatctttacttatcaaaagaagttcggcattatcttgccggttcaaattatggtagtgataccccagaggattagatggccaaagaagacaatattgaaatgcaaggtaccgttctcgaaacgttacctaataccatgttccgcgtagagttagaaaacggtcacgtggttactgcacacatctccggtaaaatgcgtaagaactacatccgcatcctgacgggcgacaaagtgaccgttgagctgaccccgtacgacctgagcaaaggccgcattgtcttccgtagtcgctaattgtctcctcacgccctgaagggcggctggataaaaggtcggtttaaccggccttttttgcgtccattaagtcgatgaatgacgagcaggttactcttccaccatccgcgcatactcttccgtcaaaaaatcgaccaacgcacgtacggaaggtaatagccctcgccgggatgggaacacagcatgaataacctcccgccggggctcccactcttccagcaccgcgaccagttcaccggcggccagttgttctttcaccattaagacaggtaactgcacaagccccacgcccgccatcgccgcctcgcgtagcgccaacatgtctgtagtaatcatacgcggggtaaaatggacttccgcacgcgcgccctgcgggccgtaaagttcccagcggtggatatgcttgccggatgcaagacttagccctggccaatggctcaactccgccggcgcggaagggattcccatccgtgcgatgagatccgggctggcaaacaggcgatgccctctgtcagccaggacgcgcatcaccaggtcgctatcttcaaacgggcgcggcctgacgcgaatcgccacatccaccccctcccctacgacgtccacccgacgattggtcgcttcaagctgtagcgaaacatcaggataacgcgccataaacttcgccagcattgggccgatgtgtacatgcagcagcgtcaccgggcaggttagcttcacgataccgcgaggctctacctgcaatgcggcaatggcatcctgcgccgcctgagcttccaccagcatcgctttacagtgctcatagaatgtttgccccacttcggtaacgttaaactgccgggtggttcgctgaatcaatcgcacgcccagccgttcctccagttgcgcaatacgccggctcagttttgattttggttcatcaagcgcacgccccgccgcggcaaacccaccctcttcgaccacatgcacaaaccacgcaaaatcattgagatccgtttttatcattacattgtcctattaatggaacggtatgagccattttacccactaccgaacattttgtcatgaatataagcttattcacatcaagacaacgccactgaggagaacaccatgaaacagattacaggcgtctataccgcacctcgcccgcactgggttggcgatggatttccggttcgttcactcttttcttatcagtcacatgcgcagcagttgaatccattcctgctgctggattatgccgggccgcacacctttacgccgggtaatgaaaaacgcggcgttggggagcatccacaccgcggtttcgagaccgtgacgattgtttatagtggcgaagtcgagcatcgggactctaccggtcgcggcggcgttatcggcccgggcgacgttcagtggatgagcgcaggcgcaggcattttgcatgaagagttccactccgacgcgtttacccgtcggggcggcgaactggaaatgatgcagttgtgggttaaccttcccatgaaggacaaaatgaccaccccgggttatcaaagcattacccacgatgttatcccgaccgttacgttgccggatgacgccggagtcgtgcgggtcatcgcagggcgttatgaagagacaaaaggcccggcgcacactttctcgccgctcaatgtctgggatatgcgcctgcaacgcaatcgccagcttacattggcacagccggaaggatggagcgccgcgctggtggtactgaaaggcaatatcacggtgaacggcacgacgccggccaacgaagcgcaactggtggtattgagccagcaagggaaaacgctgcaccttgaggccagcagcgacgccagcgtattgctgttatcaggcgagccgctgaatgaaccgattgtgggttacggcccatttgttatgaacacgaaacaagagatcgcagaagcagtccgcgatttcaactccggccgttttggccaaatctgaaaacatgaaggagaacacgatgtcaagtcctgctagttttaatggtttgcgcccggtaattgatgttaacgattccgtgatgcttttaatcgatcatcaaagcggtcttttccagaccgtaggcgatatgccaatgccggaattacgcgctcgcgccgcggcgttggcgaagatggcgacgttagcgaaaatgccggtcattaccacggcatccgtaccgcaaggtccgaacggcccgctgatcccggagatccacgctaatgcgccacatgcacagtacattgcgcgcaaaggtgaaattaacgcctgggataacgaagatttcgttaaggcggtaaaagcgacgggtcgtaagacgctgatcattgccgggacgattaccagcgtgtgcatggcattcccggccattagcgcggtagcagaaggttataaggtatttgccgtgatcgacgcatccggtacctacagtaagatggcgcaggagatcaccctggcgcgtatcgtacaggctggcgtcgtaccgatggatactgccgcagttgcctctgagctgcaaggcacctggaaccgtgaagacgcagccgcgtgggccgacgtttatactcaggtattcccggcctatcaactgctgatagaaagctacagcaaagcgcaggatgtggtgaaaaacaacgaaatgttggattcacagcgctaatttgcctccccgcgccagtttgggcggggattatgtctattgcatgagcaaacgacagtgaatatgtaaattctgcttgaccgttttagcgcaactccctatagtagcgccccgttgccccccaagcggtcaggcagcaatacaatatggtgaggtgtccgagtggctgaaggagcacgcctggaaagtgtgtatacggcaacgtatcgggggttcgaatccccccctcaccgccatatttaagttgagagcctgtacagaagtacgggctttttgcttatatgtatcccccaaaccaaggggggatgagaaccaccgaccggggttcgacaactggcgcagccagttggacagaccgggcgcgcagcgaacgggctgccccgaaggggcgagcaaagcgagtcaatccccccctcaccgccatattcaagaaagagctcgtacgaaagtacgggcttttgtatctaaacttcttgtttttactgtgattttcctgatgaaaggtttgtttttggacctttggttgctacaccaaacttactatagattgtgtaaaacagccctacttccctacctgaaacgctttagaaaagtttgcataagtatctctcggtagtaaaaaagcaccgagttcctctgtctgatgctgctgttgatttgttaaaagatttaccacgattaaaagataacaatcatgtattccctgcccctcgcgctgaaacactttctgatatgtcgttattggctgtattgaaacgaatgggatatatcgacttaacgcaacatggcttccgttctactttccgtgagtgggctggtgaagcaacggattatcaacgtgaggttattgaacatgcgttggcgcaccagttggcagataaggctgaagcagcgtatcagcgtgggacgttatggcctaaacgagtggcgctgatggatgactggacggggtatagcactgccaacagctaagctacctgtacgaaagcattatcgttgataacaacgtagaaagtgtgatgctaatagcattcgctttcgaaaatgtgataaggaataatttcacgatgaactatttcttatatgattattatcatggtttgcaaattacataaaccactcaaggagaggttatgcccggactgataggctactggaagcaacttcccaccaaagatgaatatattaaaaaacacaatatgagcaaaatatcctgctacagttgtggtcacgagaaattcagcgatgttggtttgatacaggtatgggataatcacagaagaattctttgtgctaagtgtaagactactcttttcagagaagaggattagtttttttggcattggtaacagcggcttcagcatcccttttcacgcagcgggtcgggctttttttcgcatttgacccgtcgattaccggatgatggcgcaatttacaagcgccttatccgcctaccgcgagcacaacaccatcaggctaactattagccggcataaaaaaaccgggcgctaaggcccggtttgtacggcagtgaaacgaagattagtgcgcggcttccggcttgtgcttttgcgcactctggaagtcatacgtcaacgcatttttctctttatccagcgcgacggtgacctgtccgccgtcaaccagcgatccaaacagcaactcattggccagtggttttttcaggttatcctggatcacacgtgccattggtcgtgcgcccatcgcccggtcatagcccttttccgccagccagtcgcgcgcttcctgactgacttccagggagacgcctttctgatccaactgagcctgcaactcgacgataaacttatcgacaacctgatgaatcacctcgccagacagatgatcgaaccaaataatgttgtcgagacggttacggaactcaggcgtaaacactttcttgatctcacccatcgcatcggtactgttgtcctgatgaataagaccaatagatttacgttcggtttctcgcacgccggcgttggtggtcatcaccagcaccacgttgcggaaatccgccttgcggccgttgttatcggtcagcgtaccgttatccatcacctgcagcagcaggttaaagacatccgggtgcgctttttcgatctcatccagcaacagcaccgcatgaggatgcttaatcaccgcatccgtcagcagcccgccctggtcgaaaccgacgtatcccggaggcgcgccgatcagacggctcaccgtatgacgctccatatattcggacatatcaaaacgcaacagctcaatacccagcgcttttgaaagctgtaccgtaacttcagttttccctacgccagttgggccggcgaacaagaatgagccgacaggtttatgctcatggcccaggcccgcacgactcatcttaatagcttcggtcagcgcctcaatcgcgttatcctggccgaagaccagcattttcagacgatcgcccaggttcttcagcgtatcgcgatcgctctgcgagacgctcttttcaggaattcgcgcaattcgcgccactacggactcaatatccgccacgttgaccgttttcttacgtttgctcaccggcatcagacgcgcccgagcgcccacttcgtcaatcacgtcaatggctttatccggcagatggcggtcattgatatattttaccgccagctcgaccgccgcacgcaccgctttcgcggtataacgcacgtcgtggtgcgcttcgtacttaggtttcaagccgttgataatttgcaccgtctcttccaccgaaggctcggtaatatcaattttctggaaacggcgcgctaatgcgcggtctttctcaaaaatattgctgaattcctgataggtcgttgagccgatcacccggatcttgccgctggaaagcagcggtttaatcagatttgccgcatccacctgtccacccgacgccgcgccagcgccgataatggtatggatttcatcgataaacaggatgctgttggtatcctgctcaagctgtttcagcaacgccttaaaccgtttttcaaaatcgccgcggtatttggtgcccgccagcagcgaaccgatatccagagagtaaatagtacaatcggccatcacttccggcacatcgccctgcacgatacgccaggccagcccttcggcaatcgccgttttgccgacgccggattcccctaccagcaacgggttatttttacggcgacgacacaagacctggatcgcgcgttcaagttctttttcacgaccaatcagcggatcgatgccgcccacgcgagcaagttggttaagattcgtcgtgaagttttccatacgttcctccccgccagcttgttcgtcgccagctggctgattgccgagatcggaagattggctcggttcgtcttttcgcgtcccgtgagaaataaagttcacgatatccagacggctcacttcatgcttacgcagcagataagccgcctgtgattcctgctcgctaaagatagccaccagcacattcgcgccagtcacttcactacgcccggaagactgaacgtggaagacggcacgttgcaggacacgctggaaacttaacgtcggctgcgtatcacgctcttcttcactggcaggcagtacgggtgtggtttgttcaatgaaggcttcgagttcctgacggagcgccaccagatccacggagcatgcttccagcgcttcgcgagccgatgggttgctgagcagcgccagcaacagatgctcgacggtcataaactcatgacggtgctcgcgcgctctggcgaaagccatgtttaaactgagttccagttcttgattgagcataggcacctcccccaatttttatacctgcattcaggctttttccagcgtacacagcaacggatgctcgttctcccttgcatacttgttcaccatcgccactttggtttccgccacctcggcggtaaacacgccgcagatagctttgccttgatagtgaactgcaagcatcaattgcgttgcacgttctacatcataagaaaagaatttttgtaacacgtcaataacaaactccatcggagtgtagtcatcattgactaatatcactttatacatagatggcggttttagcgcgtcgcgcacgctatcttccaccaactggtcaaaatccagccaatcgttcgtcttacccattgtcagtcgtcattatcggttacggttgtcggcaggaaaatctgccgctgaccagagtctatgcacacaatcaatctacctcaattgatagataactaacatctatcagtaccatccacgacatctgtcacattcccggcaatagcgttaactgcttcaaatttttgattcatttttacccgatcccccctgcctgatgcttgacgcctcgcctgatttctctaaattgtaatgtcgagagttggtgaggttttgaacagcccccactccgtcaccggttcattccatcttacttatataagatttacgaaggatgtcgaagcatggaaacgggtactgtaaagtggttcaacaatgccaaagggtttggtttcatctgccctgaaggcggcggcgaggatattttcgcccattattccaccattcaaatggatggttacagaacgcttaaagccggacagtctgtccggtttgatgtccaccaggggccaaaaggcaatcacgccagcgtcatcgtgcccatcgaagcagaggccgttgcatagctcctctgtctcattgtgtacatccagaaggcaaaatgccagcccgatcggctggcatttttatttaacgccagtgcctggtggcgacactgttgcatcttatcaggccgacaaatgacgtcagcaagattactctcttgccagcgcatccaccgggtccagtcgcgccgcgtttctcgccggtagccagccaaacaatatcccggtaaacgtcgaacataaaaacgcgctcgccagcgctgtcagtgaaaaaccgatctcccagccgggcaggaaaagctgtagcataaatgcgatgaacatcgacaagctaatccccagcgctccaccaaccaggcaaaccagcaccgcttcaataagaaactgctgtagcacatcgctggcgcgcgcgcctaccgccatacggatgccgatttcacgcgttcgctcggtgacggaaaccagcataatattcataacgccgatgccgccgacaaccagcgaaatgacggccaccagcgtcagaaataactgaagagtataggtggttttttcagccgttttcaggacgctgtccatattccaggtgaagaagtcttttttaccgtggcgtaaggtgagcaggcgggtaagctgctgttcagcctgatcgctatcaacgccatctttcacacgaacggtgatcgagttaagccatgactgacccattatgcgatctgacatcgtgctatagggcaaccaaacttgcaacagattgctattgccgtacatggacggtttctcttccgccacgccaataacaataaccggcatattacccaccagcaccacttctcctacgacattcgctttatttggaaatagctggcgtcgcgtgttggcatccaacaccaccacctgcgcgcgatcctgttgctgtacagcattgaaggtgttcccctccctaaaggacatgccgtaaacgttaaaataatcgccactgacgccattagcatttacggcaatatcaatattgccatagcgaagacgtaagctctttgaaacgctgggcgtcgcagagttaacccacggctgtttctgaatagccaccagatcgtcatatttcagcgcctgtcgatactgcgggttgtcgtcgccaaaatctttgcctggatgaatatcaatcgtgttagtgcccatagcgcggatatccgccagtaccatctgttttgcggcgtcgccgaccaccacaatcgacaccaccgacgcaataccgataataattcccagcatggtcagtaaagtacgcattttgttagcggccatcgctaaccacgccatcgacagcgcttcgcgaaagctgctggcaaattgccgccagccgggagccgtattaactacggcagcgtcaacgccctgttcgcgtttcttttcctgcgcgggcggattatggacaatcttgccatcgtgaatttcaataatccgctccgcctgggcggcaatcagcggatcgtgcgtcacaatgatcaccgtatgtccgcgatcgcgcagttggcgcaaaatcgccattacctcttcgccggaatggctatccagcgcgccggtcggctcatccgccagaatcacctgtccgccgttcatcagcgcgcgggcaatactgacacgctgctgctgtccgccagaaagctgtgaaggtggataatcgacgcgatcgcttaatcccagccgcaaaagcaactctctggcgcgcgcctggcgttttttgcgttcaatgccggcgtagacggcggggatttcaacattttgcgctgccgttaaatgcgacaacagatggtagcgctgaaagataaagccaaaatgctcacgccgcagctgcgccagcgcgtccgggtccagcgtcgagacgtcccgccccgccacccgataagtgccgctggtcggtttatccaggcacccgaggatattcatcagcgttgattttccagaaccggaaacgccgacgatcgccaccatctccccggcgtggatttgcagggagatatctttcaacaccgccacctgctcttctccggaggggtagctgcggctcacattgcacagttcaagcaatgccgtcatggcgtcgctcctggcctgctctcgccgatgatcacctcatcgcccgcttccagacctttaaccacttccacgtctgtatcgttacgctcgccaatgaccacttcgcgctcacgtttttcgccgttacgcaacagcgccactttataacgattaccgcccaccggctcgccaagcgcggcgagaggaataatcagcacatttttgacatccatgagttgaatataaacctgtgcggtcatatcaagacgcaagattcttttgggattcggcacttcaaaccgggcgtaataaaaaatagcgtcgttgatcttttccggcgtcggcagaatatcttttaaaacgccttcatagcgcgtttgcggatcgcctgcaatggtgaaccatgctttctgccccgcccgaagatggatcacgtccgcttccgagacctgcgcttttaccagcatggtgctcatatccgccagcgtcagaatattgggcgcctgctgagctgcaatcaccgtttgtccttgcagggtagtgatttgcgtcacttcccccgccatgggggcgacaatacgggtatattccaggttggttttcgcggtgtccaacgaggcccgattacgtttgatctgggcatctatggtgccaatacgcgcctgtttaaccgccaactccgtcgccgcagtatccagatcctgttgcgataccgcctgagtcttagctaactgctgctggcgcgccagcgtaacccgcgccagctttaactcagcggctgcctgctgacgctccgcgttcagctccatcagggtggcctcgacctcttttatctggttctccgcctgatctgggtcaatcacgccgagtagctgatcttttttaacgttatcgccaatggagaccagcagcgttttcaactggccgctcacctgcgcgccgacatccactttacgcaacgcgtccagttttccagtcgccagtacactctgttcaagatcgcctggccgcacgattaatgtctgataagttggcagcggcgcatttatcattcgccagctaaccatcccccccactaaaagaattaaaataatgaccagataacgctttttaaatttctttcccttagcacgcatagaaaccctgacggcaaaattttaaccagaaagtaaaccgtatctaaacaaacctgacgcaataaagatagcgccggctgtattgacgattggttaatgtttcctgtggttcaatctcgacaatcttatgtcgcggattacgatcatgacacagcttacagataatacctggtacacttcagattacatctctcctttacaattatttattcgtctgacgcgcgggcaattacagccaggaaaattctggcgtaaagccagctttcgtcgcaagtttttaatccgctcattagtcatgccgcgtgcaaccagccaattactgaccaatctcacccaatggccgaagttaaatacgttacttgctcgtcagccgcgtttgcctattcggctacatcgtccttatatggctgtaaatattaaacgcgatttcgccttagacgctctgtgttttcattatcaacagatgcgccaacttttatcgcgggaacaacaagttagctatttaagtcagtatggcctgaatcttgctaaatttgaagctaaaaccggcgagttgtttcaacttgatttagtcagtctggtctcactggataaagaaggtgaaagcactattgttgttcgcgacgcacagttacgtattctggcagagatcacatttaccctgtgtcgctttaaccaacaacgcacactatttatcggcggattacagggcgcggcaaacgacgtccctcacgaaattatccagcaggcgaccaaagcctgccatggtctttttcccaaacgcatcgtgatggaggctctctgtcagtttgcgcaagtctttcaggcagaaaagattatagccgtgagtaacgatgcgcacgtttatcgtagctggcgatacatggataaaaagacgcaaatgcatgccgactatgacgcgttttgggaatcgttaggcggtgaaagaattaaagggaattactatacgctgccgctggcgatcgcccgaaaaagcgaagcggagatcgccagtaaaaaacgggccgagtatcgccgccgctatgcattactcgatagcgtcgtcgaacaggttccggccacattcaaacgctaatccgcccggccccgcgccagccaaaccacgcgcgagaacatctttctgaacagcggcggcacggcgtcaattccgcgccgcccggcttccatcgcgacttcaatcgccaaatccggctttgacgagcggtggatagctttagtgataattttccgggtattcatcggcacattaagcggaagttgcgcaacccggtgaaaaacatcggcaaagccctgacgatacataaaatgttccatatccagcgtaggcagcgccgtgagatgttcgcgttcttcttcccgatcgttattaagcaggctgcggaccgtcgcggcatattttttccccgcttcgtcgccatccaccaggacatgccactcgattcccatacggcgggcgaacttcaccagcggtttcaggccagactgagcaaattcaatgactttaattccctccgcatcaaaatgatgtccacactgacgcgccagctcattaataacccaggtttccgtctcgccttccaccagtagccagcaacgcgcaaacagcgacgacgcgcgattaaagcggatatgaaaggcgatgcgccgtccatcttccgcgcttaacccgcccgtgcccagacgccaggcggcgacgcgggaagattcgcgcaccagccgtacgacatgctccaccggcgttagcgagagcagttcgcctgagttggttgtcgctatccgctgtagcggtaacagattgagcaattgccaggcgactgaaagcataatgggatgtaaacgggtttccggatcttccaccagcagtaatggtcgcgcgtctttatgtaaccgcagcgtccctttcgcctgtaacagcgtggagaaaagccccagcaggatcacccgatgcgaccggctgcccggtttgtcgatcatccgattaataatatccagatagcgccagctacgctgctcattttgcgaacgccggcgcatgagtcggtgacgcgcctgtcctgcgccctgctctgagaaatagtgttcaagcagttgcaccatcgcggacagtccctgacgaatctgcccgtcggttaaattttgcggccgggtcgccagctcacgcgccagaaaatccagttgccgggccgtgacttcaacatccggcacattgggcaccgtgccgttgcgaatacgtcgcataaagcgcgcatcgcgcaaacgtagcactggcatcagacgaaccaggtggcgcacctgatcgttaatattttccaccggcaatggctgcccatcgctattgagaaaactgcgcagcgtcatcacgctgccatcggcgccacattcgccctctagacgataaaaaatacggtgaaaatcatcctcgcaaggcgaccagcatgcttccagcgcccgataacgacgtacccgatgccgccctggctgcgtttcgcgaaaagtcagaataatatgcaggtgatgctcgcgtccttttatgtcgccaggcggaaaccagaaatcctcacggacaaaatggtagagatcgagttccggcgacaataacagagtcagcgcatccagcaggctggatttgccccaggcgttttccccaatcagcacgttgttttgctccagcatcaacgatagtcggttgataccgcgaaatcctactatttcaacgcgttcgagaatcatgcttcctccagaaaaacgtcaccactccattaaactcaccgcagtataacggcaaatgcttccgcctggcgtgatattcccccctttgcctggggcaactgtctgataaatgtacggctgacggtgtcgctttactgatagtctggaattcggtagtgtcatgtacgctattcaaacaataaaaaagggcccggctgttcatgttttcaggacttttaatcattctggttccactgattgtgggctatctcattccactgcgacataaagccgcattacaactcattaaccggctactgagctggatcgtgtaccttattctcttttttatgggaataagcctggcgtttttggataacctcgccagtaatctggtggcgatttttcattattccgccgtcagtattacgattattttattgtgtaatatcgccgccttattgtggctggaacgtatcctcccgtggcgtcaccatcatcagcaggaaaaactgccttcgcgtattgccatggcgctggagtcgctgcaactgtgcggcgtagtggtattggggtttatcatcggcctgagcggactctctgttttacagcacgccaccgaagccagtgaatatacgctgatctttttattgttcctggtggggattcagctacgaaatagcggcatgaccttaaagcaaattgtgcttaaccgccggggaatgatggtcgcggtcgttgtcgtggcaagctcattactgggcggcgtgattaatgcgtttatcctggacttaccgctaaaaaccgccatggcgatggcgtcaggtttcggctggtactctctttccggtattttgctgacggagtcgtttggaccggttatcggcagcgcggcattttttaacgatctggcccgcgaacttttggccattatgcttattcccggtctggttcgccgcagccgttcaacggcgttgggcctgtgcggagcgacctcaatggactttacgttgccggtattacagcgctccggtggcgtagagattgttccggcggctatcgtacatggctttatcctcagcctgctggtacctctcttaatggcgttcttctcggcctgatacctctctggcggtaggtatctgccgccaaaattgcgctaaatcaatctccttgcacattatggcagaaatcccttttatccctttgttcacaggcataatcttaaacatgtatattaaatataactttaaaaggtgtgaccatgttttgtgtgcaatgtgaacaaaccatccgtacaccagccggaaacggctgctcctacgcgcagggaatgtgcggtaaaacggctgaaacgtccgatctgcaggatctgctgattgcggctttgcaaggtttgtctgcctgggcggtgaaggcccgtgaatatggcatcattaatcacgacgttgataactttgcgccgcgcgcgtttttctccacgctgaccaacgttaacttcgactctccgcgtatcgtcggctacgcccgtgacgctatagccatgcgtgaagcgttgaaagcccagtgcctgagcgtggatgctaatgcgcattgcgacaatccgatggccgatctgcaactggttagcgacgatctgggcgaactgcaacgtcaggcagcggaatttaccccgaataaagataaagccgccattggcgagaacatcctcggcctgcgtctgctgtgcctgtacggtctgaaaggcgcggcggcgtacatggaacacgcgcacgttctcggtcaatacgacaacgacatttatgcgcagtaccacaaaatcatggcctggctcggcacctggcctgctgatatgaacgcgctgctggagtgcgcaatggaaatcggccagatgaactttaaagtgatgagcattctggatgccggtgaaaccaccaaatacggtcacccaacgccgactcaggtcaacgtcaaagcgactgaaggcaagtgcattctgatctccggtcacgatctgaaagatctctacaacctgctggagcagaccgaaggcaccggcgttaacgtctacactcacggcgaaatgctacccgcacacggctacccggaactgcgtaaattcaagcatctggtcggtaactacggcagcggctggcagaatcagcaggtcgaattcgcccgcttccctggcccaatcgtgatgacctctaactgcattatcgacccgaccgtgggcagctatgacgaccgtatctggacccgtagcatcgtcggctggccgggcgttagccatcttgaaggtgatgacttcgggccggtcattgcccaggcgcagcagatggcgggcttcccgtatagcgaaattccgcatctcatcaccgtcggttttggtcgtcagaccctgctcggcgctgccgatacgctcatcgatctggtcagtcgtgaaaaactgcgtcacatcttcctggtcggcggctgtgacggcgcgcgcggcgagcgtaactactttaccgatttcgtcaccagcgtgccggatgactgcctgattctgactctggcgtgcggtaaataccgtttcaacaaactggagttcggcgacatcgaagggctgccgcgtctggtcgatgccggtcagtgtaacgatgcttactccgcgattatcctggcggtgacgctggcggaaaaactgggctgcggcgtcaacgatctgccgctatcgctggtgctctcctggtttgagcagaaagcgatcgttattctgctgacgctgctgtcattaggcgtgaaaaatattgtcaccgggccgaccgcaccaggcttcttcacgccggatttgctggctatcctcaacgagaagttcggtctgcgctccgtgaccactgttgaagaagacatgaagcaattgctgagcgcgtaaggaggccaatgatgacgatgccaacctcacaatgtccctggcgaatgcaggtgcatcacatccgtcaggagacgccggatgtatggacaattgcgctattatgccatgactactacccttaccgcgccgggcagtatgcgctggtgagcgtgcgcaattcagcggaaacgctgcgcgcctacaccctttcgtctacgccgggcgtcagtgaatatatcacgctgaccgttcgtcggattgaagatggcacgggttcacagtggttgacccatgacatcaagcgcggcgattacatctggctgtctgatgcaatgggcgattttacctgtgacgataaaacagaagataagtttctgctgctcgccgccggttgtggcgtaacgccaatcatgtcgatgcgtcgctggctggcgaaataccgcccgcaggccgacgtgcaggtcatctttaacgtccgttcgccggatgatgtgatttttgccgacgagtggcgacagtatccggtcacgctagtggcggaaaatcatgccacggaaggttttatcgcgggccgtctgaccacggaattgttacagcgcgtaccggatttggcatcgcgcactatcatgacctgcggcccggcgccctatatggatttcgttgaacagggagtgaaagcgcttggcgtaacgcacttctttaaagagaagttcttcacgccggtggcggaaacggcaaccagcggcctgaaattcaccaaactacagccagcgcaggaattttatgccccaatcggtacgacgctgctggaggcgctggagagtaataaagtaccggttgccgctgcctgtcgggcaggtgtttgcggctgctgtaaaaccaaagtcgtttccggcgactatacggtgagcagcaccatgacgctgagcgaggcggagattgccgaaggttacgtactggcctgctcctgccatccgcagggcgatcttgttctcgcataatcggtaaacgttccatcgtaggcccggtaagcgtcagcgccaccgggcgatttaccactcgcttcatcctttcgcccctctctccgccaaagaaaaacgtcatcgtcatcttcaactaaacttgtaaccgttatcacatttaaggagatggagaaccatgaaacaaaccgttgctgcttttatcgccaaaacgctggaacaggctggcgtaaaacaaatctggggcgtcactggcgactccctgaacggcctgagcgatagtcttaatcgtatgggaaccattgaatggatgccaacccgccacgaagaggtcgccgctttcgccgccggcgcacaagcgcagcttaccggcgagctggcagtgtgcgccggttcatgtggaccgggcaacctgcacctgatcaatggcctgtttgattgccaccgtaaccacgtccctgttctggcgatcgccgcccatattccgtccagtgaaatcggcagcggttatttccaggagacccacccgcaggagttgttccgtgaatgcagccactattgcgagttggtttccagcccggagcagatcccgcaggtactcgccatcgccatgcgcaaagcggtgctaaatcgcggcgtctccgtggtcgtacttccgggtgacgtggcgctgaaacccgcgcctgaaaacgccgtcacccattggtaccatgccccgcaccccgtcgttacgccggcggaggaagagctgaaaaaactggcgcaactgctgcgctactccagcaatatcgcattgatgtgcggtagcggctgcgcgggcgcgcatgaggagttggtcgcgttggcggcaaaactaaaagcgccaatcgttcatgccctgcgcggcaaagagcacgttgagtacgataacccttatgatgtgggaatgaccggcctgattggcttctcttctggcttccacaccatgatgaacgccgatacgctgatcctgctcggcacccagttcccctatcgcgccttttatccgagcgatgccaaaatcattcagattgacatcaacccgggcagtattggcgcgcacagcaaagtcgacatggcgctggtgggcgatattaaagccacgcttcgcgccctgctgccgctggtggaagaaaaaagcaatcgtaaattcctcgataaagctctggaacactatcgggacgcccgtaaagggcttgatgacttagccaaactcagcgataaagccatccacccacaatatctggcgcaacaaattagtcatttcgccgctgacgacgctatttttacctgcgatgtcggcacgccgaccgtctgggcggcccgctatctaaaaatgaacggcaagcgccgcctgctgggctcgtttaaccacgggtcaatggccaacgccatgccgcaggcgctcggcgctcaggccaccgcgccgggtcgtcaggttatcgcgatgtgcggtgatggcggcttcagtatgctgatgggcgattttctctcggtggtacagatgaagctgccgataaaaatcgtcgtctttaataacagcgtgctgggctttgtggcgatggaaatgaaagctggcggttaccttaccgacggtaccgaactgcacgacaccaatttcgcgcgtatcgccgaagcctgcggcattaccggtattcgcgtggaaaaagccgcagacgtggacggagcgctacagcgcgcgttttccatcgatggcccggtactggttgacgtggtcgtggcaaaagaagagctggcgatcccgccgcagatcaaactggaacaagcgaaaggctttagcctgtacatgctgcgcgccattattagcggccgcggcgatgaagtgatcgaactggcgaaaacaaactggctaaggtaaaacagtgcacatcaccttttaaaatccagggatgtgccatgattgatttacgcagtgataccgttacccgaccgggccgcgccatgctcgaggcgatgatgaccgccccggtcggggacgacgtatacggcgatgcccctaccgttaacgcccttcagcgctacgccgccgacctttccggtaaagaagcggcgctttttttacccaccggcacccaggccaatctggtcgcgctgcttagccattgtgaacgcggcgaagagtatatcgtcggtcagggcgcacataattatctctatgaagctggcggcgctgcggtgctcggcagcattcagccgcagcctattgatgccgccgcggacggtacgctgccgctggagaacgtagcggcgaagattaaagcggatgacatccacttcgcgcgcacgcgcttgctcagtctggaaaatacgcataacgggaaagtgctgccgcgcgcgtatctgaaagacgcctggacgtttacccgcgaacgtgggctggcgctgcacgttgacggcgcccgaatttttaacgcggtggttgcctacggctgtgagttaaaagagattacgcagtattgcgactcttttaccatctgcctgtcaaaaggtctcgggacgccggtcggttcgctgctggtcggcaaccgcgattacattaaacgcgcgacgcgctggcgtaaaatggtcggcggcggaatgcgtcaggccgggattctggcagcggccggactgtatgcgctgaagcataacgtggcgcgtctgcaagaggatcatgacaacgccgcctggctggcgcagcagcttcgcgaagcgggcgcggatgtcatgcgccacgaaacgaatatgctgtttgttcgcgttggcgaagcacaggccgccgcgcttggcggctatttgcgggaacggaatatcctgattaacgccgcgccgattgtgcgtctggtgacgcatctggatgtctctcgcgaacagcttgccgacgtcgtcgcccactggcgcgcctttttagcccgctaaggagagcaacgtggcgcaacgcattctggtcctcggcgccagcggctatatcggtcagcacctggtctttgcgctaagtcagcaaggacatcaggtgcgggcggcggcgcggcgcgtggaacgtctggaaaaacatcgcctcgccaacgtcagttgtcataaggtcgatctgcactggccggaaaatttacccgcgctgcttcgcgacattgataccgtttactatctggtacacggcatgggcgaaggcggcgactttatcgcccatgagcgtcaggcggcgctcaacgtgcgcgacgcgctgcgccagacgccggttaaacaacttattttcctcagttcattgcaggcgccggcgcatgagcaatccgatcacctgcgcgcccgccagcttacggctgacacgctgcgcgacgcaggcgtaccggtgacggaattacgcgccgggatcatcgtcggcgcaggctccgccgcctttgaggtcatgcgcgacatggtttacaacctgccaatactcacgccgccgcgctgggtgcgttcgcgcaccacgcccatcgccctggaaaatttactctactacctggtcggcttactggagcaccctgcgcacgagcatcgtattctggaagccgccgggccgcaggtattaagttatcagcagcagtttgaacgttttatggccgtcagcggtaaacggcgtccgctgatcccggtgccttttccgacccgctggatttcggtctggtttttaaacgtcattacctccgtgccgccaactaccgcaaaagcgttaatccagggattaaggcacgatttgctggccgatgacgccgcgttaaaaaagttgatcccccaaacgcttatcacctttgatgacgccgttcgccgcacgctgaaagaagaagaaaaactggtgaactccagcgactggggctacgacgcgctggccttcgcccgctggcgtcccgaatacggctattttccaaagcaggcgggctttaccgcgcagaccccggccagcctatcggcgctatggcaggtcgtaaatcggctgggtggcaaagagggctattttttcggcaatattttgtggcagacgcgcgccgcgatggaccgtctggtggggcataaactggcgaaaggccgcccgtcgcataccttgctcaagcctggcgatacggtagatagctggaaagtgatcattgtcgaaccagaaaaacagctcacgctcttgtttggcatgaaagcgccgggtctggggcggcttagcttcacgctgcacgataaaggccgctaccgcgaaattgacgtgcgcgcctggtggcatccacacggaatgccgggcctgatttactggctactgatgatcccggcgcacctgtttattttccggggaatggcaaggcgtattgcccgacttgcagaacaaatcacagaaaaatgagaaaaagttgctgtattctttcgtgtttcccattgcataccgacgtaattcacggaagaatgcgcacgacggtttattaaacacagtggattgatatgaaggtactggttaccggcgccaccagcggcttaggtcgaaacgcggttgaatttttgcgcaataaaggcatcagcgtcagagcgacgggtcgcaatgaagcgatgggcaagctgcttgaaaaaatgggcgcggaattcgtccatgcggatttaaccgaactggtctcctcgcaggctaaagtgatgcttgccgggatcgacacgttgtggcactgctccagctttacctcgccctggggaacccaacaggctttcgatctggcgaatgttcgcgccacccgccgtctgggagaatgggcggtcgcctggggcgtgcgcaattttattcatatctcctctccctcgctctattttgattaccaccatcaccgtgatatcaaagaagatttccgcccgcatcggtttgccaatgagttcgcccgcagtaaagccgccggcgaagaggtgattaatctgttggcgcaggccaatccgcaaacacgttttacggtattgcgtccacaaagcctgtttggcccgcacgataaagtatttatcccacgtctggcgcatatgatgcaccattacggtagcgtcttattaccgcacgggggcagcgcgctggtcgatatgacctactatgaaaatgcgatccacgccatgtggctggccagccagccgggctgcgatcatctgccttctggccgcgcttataacatcactaacggcgaaaaccgcaccttacgcagcatcgtacaaaagttaattgatgaattgactatcgactgccgcattcgctctgtgccttacccgatgctggatatgatcgcccgcagtatggagcgcttcggcaaaaaatccgccaaagagcccccgctaacgcattacggcgtgtcaaaactgaattttgattttacgctcgatacgactcgcgcgcaggacgagctgggctaccagcccatcgtcacgctggacgaaggcattgagcgcaccgccgcctggctgcgcgatcacggaaatttaccgcgttaatcctggccgtacttctccagtaatgcttcggcaatcgcctgcgtttcggcatctgcgataccgttccattgcgccggacggaagtgcatctggaacgccataatcacccgctgttgctcgcgcgccgtcatatcggctttgacttcatagccatagcgcgagagtaacgcaagcaccgttgcggtatcgactggcgtatacggcgcgcgtccagccagataaaacgccacacgctgggcgtcaggccaggcgccaatcccctgtgccgccagctcgcgccacgggaagcgcgggccgggatcgtctttacgctgcggcgcgatatccgcatgggccaccacattctgcggtttgatgtcatagcgcgcgataatgtccttcgctaacgggatcaatgcctgaatttgcgcggattcaaacggcgcgaaagatttcaccccgccggacattcgccagccgcgattttccagctcaatgccaatagacgtatcattgagacgcgtggcgcctcgccagaaactgacgcccgcatgccaagcctgatcctgttccggcaccagttgccagatgcgcggtttaccgccatataatggcggggttgcgggaatcaggtaatgcgaactgacgttgcgacccgttaacgtcgccagcgaaacgtcaaagttttccgccgtatagtgaatcaccaggactttaatgcgcggataggccgcctgcgcccgatgtcgggtatcaagctgatatccctctttatcgataattcctttttcgctcgcgcagcctgttaacagcaacgcgagaccaaccagccacagtagcgctttcatcggcgcgttttcaccgccgttccgctgacgctgaccatcagcatactgccatccttgccgacagtttcgtaatcaatatcgatgcctaccaccgcatcggcgcccaacgctttagcctgctcgccaagttcctgaaaagcgatttcacgcgctttacgcagctctttctcatacgcgccggaacgtccgccgacgatatcccgaatgccggcgaaaaaatcgcggaaaatattggcgcctaaaatggcttcgcccgttaccacaccgcaatactccacgatgctttgtccttccagcgttggggttgttgaaaactgcatagtgaatctcccgggttagctaagcacacgatctcaaacgcattatcaagctgatacgctatcattgaaaggatataattgattatcgtagatcggtttttgctcgatcgcctataaggaaatcatcatgcgctattctaaactctctttgctcatcccgtgcgcgcttctgcttagcgcctgtacgaccgtcactcccgcctacaaagataatggcccgcgtatcggcgcgtgtgtggaaggcggcccggacagcgtggctcaacaattttacgactaccgtattcaacaccacagcaatgatatcgccgcgcttcgcccctacttgagtgataacctggcgaaattgttgaccgacgccagccgcgatacggaacaccgccagttgatgagcggcgatatgttctccagccgcgctacgctgccggatagcgccaacgtcgccagcgcatcaaccattccgaaccgagatgcgcgcaatattcctctgcgggtggcgttaaaacagggcgatcaaagctggcaggatgaagtgcttatgattcacgaaggctcatgctgggtgattgacgacgttcgctatctgggcggagatgtccatgcccctgccggtacgctgcgccagtcgatagaaaaccgttaacagtcagtattccccgcttttgcacccataaccccgtaaattgtctggcattctgcacgggatgccgacaattcttcttacctactattcctcctgctattttgtgctatgtttagggaagaatgtgggatatatttaacttttaacgcataaatattgcataactattctgcgaaaggtactatctgcggcttcaatagctatcagactgcctgtatacgagtgtcaatgagtattcaattaaacggcattaattgcttttacggcgcgcatcaggcgctgttcgatatcacgctggattgccccgaaggcgaaacgctggtgttgcttggcccaagcggggcgggtaaaagttcgctgctgcgtgtactcaatctgcttgagatgccgcgctccggcactctgactatcgccgggaaccattttgactttacgaaaacgccgtccgataaggcgattcgtgagctacgtcaaaatgtcggaatggtctttcaacaatataatctttggccgcatctcaccgttgtgcagaatctgattgaagcgccctgccgcgtactgggtctgacaaaagatcaggcgctggcgcgcgcagaaaagctgctggagcgtttacgtctgaagccctatagcgatcgttatccgttgcacctttccggcggtcagcagcagcgcgtcgcgattgcccgcgcgctgatgatggagccgcaggtgctgctgtttgatgaaccgaccgccgcgctggacccggaaattaccgctcaaatcgtcagcattattcatgagctggcggaaacgaacattactcaggtgatcgttacgcatgaagtcgaagtggcgcgtaagaccgccagtcgtgtgatttatatggaaaatggtcacatcgtcgagcacggtgatgcgggttgctttgctcaccctcagaccgaagcgttcaaaaactatctctctcactaagattcgggacaatgacaatgaaaaaagttctgattgccgcgctaattgcaggctttagcctttccgctacagcagcccagaccattcgttttgcgaccgaagcgtcctatccgccgttcgaatcgatggatgctaataacaagattgtcggctttgacgtcgacctggccaacgcgctatgtaaagagatcgacgcctcctgtacctttaccaatcaggcgttcgacagcctgatccccagcctgaaattccgccgcttcgacgctgtaatggcgggaatggatatcacgccggaacgtgaaaagcaggtgctgtttaccacgccatattacgacaactccgcgctgttcgtgggtcagcagggcaaatacaccagcgtcgatcaactgaaaggtaagaaagtcggcgtacagaacggtacgacgcaccagaaattcatcatggataagcatccggaaatcaccaccgtaccgtatgacagctatcagaacgcgaagctggatctacaaaatggccgtatcgacgctgttttcggcgacacggcggtcgtgaccgaatggctgaaagccaatcctaagctggcgccggtcggcgataaagtcaccgataaagattatttcggcaccggcctgggtatcgcggtacgtcagggcaacaccgagctgcagcagaaattcaatactgcgctggaaaaagtgaagaaagatgggacttacgagaccatctataacaaatggttccagaagtaatctttgatgaacgaattttttcctttagcaagcgccgccgggatgaccgtcggccttgccgtctgtgcgctgatcattggcctcgcgttagccatgttctttgccgtctgggagtccgtaaaatggcgcccgattgcctggataggctccgcgctggtcactattttgcgcggcctgccggaaattctggtggtgctgtttatctatttcggctcctcgcaactcctgcttacgctgtctgacgggtttaccctccatctcggttttacgcagatcccggtgcaaatggagattgagaactttgacgtcagtccgttcctgtgcggcgtgattgcgttgtccctgctgtatgcggcctatgcgtcgcagacgctacgcggcgcgctgaaagccgttccgtctggtcagtgggagtcgggtcaggcactgggattatcaaagacggcgatttttttccgtctggtgatgccgcagatgtggcgtcacgccctgccagggctgggtaatcagtggctggtgttgctaaaagatacggctctggtcagccttatcagcgttaacgatctgatgttgcagaccaaaagtattgccacacgcacccaggaaccgtttaactggtacattattgcggcggctatttacctggtcattacgctgatcagtcagtacattctcaaacgcatagacctgcgcgcaacacgttttgagcggaggccggactaatgcttgagtacttacctgaactgctaaaagggctacacaccagcctgacgctgaccgtggcttctattgccgtcgctttggtgctggcgttagtttttaccatcatcctgacgctaaaaacgccgttcgtggtgtggctggtgcgcggctatatcacgttgtttaccggtacgccgttgttggtgcaaattttcctgatctactacggacccggtcaattcccgacactgcaagagtatccgctactctggcatctactgtctgaaccgtggctgtgcgcactgatcgcgttgtcgctaaacagcgccgcttacaccacgcagctattttatggcgcgattcgcgcgattccggaaggtcagtggcagtcctgcggcgcgctggggatgagtaagaaagatacgctggcgattttgttgccctatgcgtttaaacgcgccctctcctcctattctaatgaggtggtactggtcttcaaaagtacctcgctggcctataccatcaccttgatggaggtcatggggtacagtcagttgctctatggtcgtacctacgatgtggtggtatttggcgcggcaggcgtaatttacctggtcgtcaacggtctattgacgctgatgatgcgtttgattgagcgtaaagccctggcgtttgagcggcgcaattaaccaggcaggataaggcattctcgccgccgttcgacaatggtcagatggcgctgcgcttatcaagcctacgatgcataatattgaataaacccgacggacaagtggttaacttgtccgtctttttttatccattttaaaatatttaatcatttttattgcatacaaattcaattgatggcattgtaaatctatgccgcagacacggcgcataatcataagattacgggagtgacatcatgaaaaagttagttctggctgcattactcgcctctttcgccactggcagcatcgccgctgaaaaaatcaatttcggggtttccgccacctatcccccgtttgaatccctggatgcgagtaataaaattgtgggcttcgatatcgatctggcaaccgcattatgcaagcaaatgcaggcagaatgtacttttaccaatcatgctttcgatagtcttatcccggcgctgaaattcagaaaatatgatgccgtcatttccggaatggacattaccccggagcgcagtaagcaggtcgcctttagcaatccctattatgcgaactccgcgctggtgattgccaaaaaagacacctataaaacctttaccgatctaaaaggtaagcgtatcggtatggaaaatggcaccacgcatcaaaaatatctccaggataaacatccggaggtcaaaaccgtggcctacgacagctaccagaatgcgattatcgacctgaaaaatggccgtattgacggcgtctttggcgataccgcagtggtcaatgagtggctgaaaacgaatccgcaactgggtccggcaacagagaaagtgaccgatccgcaatacttcggtaccggacttggcatcgcggtgcgcccggacaataaggcgttgctggaaaaactgaataatgcgctggccgccattaaagcggacggcacttatcagaaaatcagcgatcagtggttcccgcagtaaaacgtatgtgattagcccaccgtgttgcgaaatggcagtataaataccttattcagcccacgggccgctatcggaaactatcctggcctgataagcgcagcgccattgagcattctacagtttgtcatcagtctcaaaggcctgcatcaacaggcgattcggactcatacttgccgggtgacgctaacgcgtacccggcttacaacattgttatgtttttagacaacatccagacccagacggcgatactgctccgccggagcgtcattttctttcatcaaacggataagtaagttgatcatccttacttcgatggcctcatcatgaataggatgttgctgctgcggatcgtctctgagatcaaacaagagatgaccaaagctattcacacctttatatttttccctggccggaatacgtaatacctgaagccctttagtgaatttaaacggaggtgccagagataattttcccagttcatccacgtcataacgcgcattcatcttgatcggcattaacgtgtagttcgcaatgtcatgctcacgccccggctgcgcggcccgcatataaacatagcgtccgtcggtaacattaacatgtccgctaaacacgccaaacagcgcgccttccctgacgggttcatcactggcaatgactttcgccagaggttggccctgcatatctgcgggaataggttgctgaaaataatccagtagcgttggcgcccagtcaatcatctgcaccagcgactgccgtcgcgctccgcataccgcgctgcgcgggtcccagataaacagcgggttattcgccacctcgttataatagggcatttgatttttagcccaccaaccgtgctcccccagcaagaagccgtgatcggtaccgacaatcagcatcgtatcgcgccagagatcgtgttcatccatcagatcaaggatacgtcccagattgcggtcgcacatggaaaccagggcccgataacgacagcgaatatgcgctatcgcctcctcactttcactgactttgccgcgcggccagtcataatgcgagccttgccactcatcgtcatagagcgataaatattcctcggtggtataaaacggctcatgcggatcgaacgtctcaacctgcaataaccagttatcttcggcatgatttttatggataaaatcgcacccggcgtcaaaaactttcgtctggggaaaatcggcttcctgctggatgtattcgcggttcgcccagtcatgacgccatagcccggaaacgccgcctccggtttgtttttgtggaacgcgcagtacttccggaatgggcggctcgccaacacttgccttccagtgatcgccctcctgaccgcgtactacgtcccaggagctatagcggttatggtagttaccgccgccgtcttcccagtaatgcagatgatcgctgataagatgggtgtagatccccgcttttttcaataattccggcatggaatcatcaaagggttccagcggcccccactcacgatgcaggaaattatagcgcccggtgtgcagttcccgacgggctggcatacagggcatactgccgacataactattgtcaaaggtggcggcatgtgccgccaggcgttgaaagttaggcgctttcgttagcaaatcaccatagggcggcaaatagtttttattcagactgtcaaacagcagaataatcgctttcatgactcaccctcatttgttgagcaggtgcggaaaatttttctctaccacatcgtaaatctgtttacctattgattcgctatccatgatattttcaatgggaatgagatattgtccgtgtttaggatcgaggctaacaacatcaagcaattttttcgaaatcgcataaatatctgcccagtcggtaaatccaccgacctctcccgctgccgtatgctccatatcaaaagagaagtcatattttgctaacgcttttttaacaacagtctgtaacattacgctactgcctacaccataaccgcatacgaataaaatatttacagaatctttcataataaaatcctttatatataaaccgaatcaattaaatggaataaggaccaagatggaacgttgaagcaataaatttcagtaattcacaaatcgcaggccacagagtcgcccagtcaaatattcccgtccagcccacgccttcttttgccagcccggttaaaggaatggcccataccgtaccgaaagtctgaataatccctaacaggaaagtacaaataataacggaacgatatccccccattcggttggctaatacgccgatgggaccgccggaaaagaagagcggaacaaaaccaggcaataccataatagggctatggatgagcagcaggatgcccatggaaaaaatcgtgccgaaagtacaaaagacgaatcccagcgtggccgcgttaggcgaaaaaggtaataaagcagcaacatccacagccggtatggcgttaggaataaagcgatcctgccatcctttaaacgaaccgttaatttcaccaaccatcatccgcacgccctgcagcaagatgaccatatacatagagaattgcaggcccagattgataatatagatataccagggtttgcctttcgccattaactgtacgttatcgatccctgtcgccaatagaaaaccgccaacgaagagcgtcatcacaatggcgattgccgtcacgttgtggttaaaaatagctaaccaaccgggaagtttcaggttttcggcgtcatgcttttccggatcgccgaatttatgcgcgaatttcgagaaaaaccacagccccagcatctggttatgcgcgatggtaaaaccggcgttattggtcactttggcgatgggtttaacaataagcgtggttgaaaacgcccaaaagaccccggtcaataccccggcaatcacaatggattgtacccaaccgaaccctagccagaagacgattaaccacagtaccgcctgtgaatgagagaccccggtattaccggtaagaaatataccttttgcgccggtataacggccaaataaaactaatatcaggttagtaaaaaacgccagtacaaaaacgtatcctacatagccgaaattatcgcccagcgctatttgcgtcgcagctttcatggcgtatgaatccattaagtatccatgtacgccataagccttgctgactgcttctgcaaccggtttaaaagtggctgaaaattgaaagccgccaaataacaccatcattaaaccgaccatcgcgctgatcataccggtgataatttttataggcgtctttttatccagcgcatagccaacaccgactaatatcccaattaatattgccggttcagttaaaaacgtttgaataacatctataaatttggcaaacatcgtctgaacgccctccataagcgtgtctattcgttgtcataattaacccctttactgacgttacgtattgcttcgctgatgctattgaaagttacccgataaaccaccttgtctaattttgccttacacgcactgtaataatcaaaattagtcattaaaagatttaaagtgattatttgtgatttgatttgcaaaaatagggtaatatataaccatgatcgatcggagtttttcatcgatcgatcatggttattattatttatggataattagacagttaatatagatattttgtatgcttggcttttggcgctacagcctgcaaagcagtgttaacacttcataatgcgcggtatgggggaacatatcgaaaagctgaacacgttgaatacggtagttcggcagatggcgaatatcctgcgccatcgtctgcgcgttacagctcgaataaatgataaaacgcggcgccatttgtgcaaggtaatcgcacaacggcttgccaatgccgcggcggggaggattcaccaacaccagatcgggcgtttcgccttgtgcggtggcgaattgggtggaatccagcgcctggaaatgaaggcgggttaatcccagctcggcagcggattgcttcgcgcaggcaatcgcctccggcgcgatctcaataccggttaattgcatctgcggcgtcgcgcagtgcaggccgaatccgcccactccgcaaaaaagatcccacatatggcgtaccggcaattgccctacccagtcgcgcgccgtcgcatataatcggctggcgaccgtagggttggtctgaaagaaactttgcggacgaatccacagcggcacatcgttaaaacgttccgccagcgcctgctgatccgtcagatagatttccgtctccccttccataatcgccatatgtaccggctggatattcgcggtgatcactctgagctgcggcagttgcgcgcgcagccacggtaacgccgcgcgcagttgcgtaagtttggtttctgaacgcaacacgaagcgtagcatcatgccgccatcgaactgactttccgtcagcaacaggtatttcagttcgccgcgttttcgcgccacgttataaggcgtgagtccggcacgggcaataaaaggttttagcgcgctgaatacgggggcaaaggaggcgggatacagcgggcaagcgcaaagatcgaccggcgtaccgtcgcgatgcagcatcccgaagagcggtttttctacactaccgctcacgaccattttcgctttgttgcggaaatgctgttccgggccgctaatcggcgcgcaccactgttcaacaggcagcccggccagcaaacgatgtaaatcggctgtttttgcggaaagttgttcgttaaccgactgcgtaatccattgacaggaacggcagcgacccgcgtcatagagtgcgcactgcataccaaaaaaccttcatattatccggggtgacgattatacacattattgcagccggaagaaccgacggctgggagcgggaataaacagcagaaacagaattaaaagatcggggagtttttgcatgaccagggaatgcaggatatcacgcttcgattctcccgcgatgctaaacaactccggatacccgtagcctaacgacgccgcccacagatacccactcacaataatttgtgccgccaggtacacccagcgcgcccagctacggcctttcaccagcgaaaacgcacaataaatttcaataaagaccagcactaagctggccagaaagaccagggttaagctccacgtctgcacgctgcgatgaataaactcgcccatcccgcgtatgccgagggtattcataatcatcagcacatcgagaccgcgaatcaaaataatcgccatagccgcaacctgcaccagcgtaggcacatttaaacgggcatgtgatgaggttgattgctttataaatcccaatgaatgtcttccctgaaaatgatgccgcgactcgcgcggcaacgcattgccatagtggaagattttagtggcttcagccgcgtcttgcacgctggatatcgcgaatccgctgtttttccgctcgcgccatcaggtaccaggcaataaatccgatgattcctaccacgccgaggattaacgtcgccagcgcgttgatttccgggttcacacccatgcgcacgctggagaaaaccagcatcggtagcgtggtggcgccgggaccggaaacgaagctggcaatcaccagatcgtcaagggagagcgtaaaggccaacagccagcccgagatcaccgctggcatgatcatcggtaacgtaatgacaaaaaagaccttcaacggcgccgcgccaagatccatcgccgcctcttcaatcgaacgatccagttcgcgtaatctcgaagcgatcaccactgccacataggcggtacagaaagtgacgtgcgccaaccagatggtcagcattccgcgatcggagggccagccgatagtatgaccgagcgcgacaaacagcagcagcagcgacagcccggtaatcacatccggcatcaccagcggcgcggtgatcataaacgcaaagccgtttgcgccgcgaaatcgtccaaatcgcaccatcaccaccgcggcgatagtaccgagcaccaccgccatcgtcgccgcgcaggcggcaattgtcaggcttagtcccactgcgctcatcatggcggtatcccgaaagagctcgccataccagcgcgtcgaccatcccgcccacaccgtcaccagcttcgaactgttaaacgagtaaatcaccaacattaacatcggcgcatagagaaaagtaaaccccagcaccagaatcagaatgcgccagggcgagcgaacgaccggtaagttattcatccgtgctcccccacacttttttgctgatgtttatggaaccacatgatcgggactatcagcagcagcaacataataatggcgaccgcagaagccaccggccagtcgcggttattgaaaaactcctgccacaggacgcgaccaatcatgatactgtccggcccgccaagcagttccgggatcacgaactcgcccaccgccgggataaaaaccagcatcgagccggcgatgattccgcctttggtgagcgggacaatgatgctaaaaaatgttttcatcggtcgggcgccgagatccagcgacgcttccaccagcgaataatcaatgcgcgtcaacgcggtataaatgggcagaaccataaacagcagatacgcataaacaatgccgatatagacggccaggttagtgtgcaggatcgtcagcggctgatcgataacccctagccacagcaacacattgttcagcacaccgttgtttttcaaaatgcccatccaggcatagacgcgtattaaaaaagacgtccacgagggcagaatcaccaacagcagcaggatattgcgcgtggagggcttgctgtgcgccaccgcccacgccagcgggtagcccagcagcaggcagcagattgtggaaataccggcaatttgtaacgattgcagacaggcttcgaaatagagcggatcgtcggtcagttgcaaaaaattgccgaggttgagcgtaatcgacaactgaccgtcagcccattccagcagatcggtatacggcgggatcgcccgcgccatttccgccaggcttatcttaaagacgataagaaacggcagtaaaaacagcagaatgagccagatataaggcaaagcaataaccagcttacgcccatgtttcatttgcattcgcgccaaccatagcgccgcgccgccaggtttactgatgcgtgccggaggttcaagtgtgctcatgtttcccccttataccgtcaggaccacgcagctatccgcttcccagcacaaacgcacttcatcgccccaggtcggtaaccctttccggtaacggtgcgcattctgcagttgagcgctgatcatctgcccgctttttagccgcacatgataaatagacagatcgccgagatacgcaatatgcgccacttcgccgacggcgaaattatagccatcggcaggcggcgactcacacagcatgattttttccggacgtagcgccacatataccggcacattatcaacgacagaggcatctgcatcgacttttaacggatgaaccaaaccgggcgcgtcaatgaccagaccgtcctcttcacgcgctttcagtaagccctcaaaaacatttaccgatccgataaattcggcgctatagcgggttgtcggatgctcgtaaatctcctccggttcgccaatttgcacaaattttccacggttcatgatggcaatgcgccccgccatcgtcatggcttcttcctgatcgtgcgtcaccatgacgcaagtcacgccgacgcgctcaaggatatccaccacttccagctgcatccggtcgcgtaattttttatccagcgcgcccatcggttcatccaacaagagcagcttaagacgtttcgccaggctgcgcgccagggccacgcgctgacgctgaccgccggaaagctgatgcggcttacgttttgcaaactcctgcatgtgcaccagacccagcatctcattgacgcggctggtaatctccgccttcggcagtttgtcctgcttcagaccaaaagcgatgttctgctctaccgtcatatgcggaaacaacgcataggactgaaacatcatattaatcggacgctgatacggcggaacatgcgccagatcgacgccgtcgagcataatttgcccgctgctcggcggttcaaaacccgccagcatccgtaacagagtcgattttccacaacctgacgcgcccagcagggcaaaaatctcacctttatagatagtcagactgacatcatcgacagcatgttgcccgtcgaatgacttcgtcaggttgcgaatttccagaagcggcgtcagcgctttacgggttttcacctgcgggcggtggggggcatcattcacaaggcgctctccggcataacacaatcaaacgatacaaacggtggaatgcccgatagcgcacgcttatcaggccataccgttaataaattacttaccgcttttcaccttcgtccatgcgcgggtgcggacgcgatcaatcttcggctcctgcactttcagggtaaacaacttggcccgcacatccgccggcggataaattcctgggttatcgcgcacctgctggctgaccagcgccgtcgcctctttattcgcattggcgtagaaaacgtgatcggaaatatgagcaatcacatcaaggcgcagcagataattaaggaactggtaggcctcgtctttatttttggcgtcagccggcatggcaaacacatcaaaaaatgccattaccccctctttggggatcgagaaagagatattgacgccatttttcgcctctttcgcccggttagcggcctgccagacatcgcccgcccagccgatggccacacaggtatcgccattagccagatcgttaatgtattgcgaggagtggaaatagcgaatgtttggccgtagcttcaacaacagatcggttgccgggccggtgtagtcatccgctttgctgctattcggatctttacccagataattcagcacggtggcaaaaatttcttcaggcgcatcaaggaaagagacgccgcagctttttagcttctccagattttccggcttgaggactaaatcccagctattcactggcgcatcatcccccagcaccgctttcactttatcaacgttatagccaatgcccgtcgtggcccacatatagggcatggcgtatttgttgtcaggatcgtgcttcgctaccagtttcagcagttcaggatcgaggtttttccagccgggaagtttgcttttatccagcggctgaaaaacgcccgcggtgagctggcgctcaagaaaactggccgatggcaccaccagatcgaacccggtgctgcctgccattaacttgccttccagcacttcgttagagtcaaagacatcatagataacgttaatcccggtctctttttcaaagttcgccaccgtgtccggcgcgatataatctgaccagttataaatgtgcagcgttttttgttcggcagcgagcgtgccgacagagacgaccatcagagcacccgcaaccagacccgatagccattttttctttaaggcggtcatcatcgctttccttctaaaatccgttaacaaatgaacccattaggcgtggtttaaaacatgcctgaaatgtgcataccttttcatttgatacaaatgaagaagagaggtcgccctccctgccatcaagctcgctatagaagcttcgcaagaataactttagctaaggtttgaggctatagcccagattaaaaaacgccttttatcaattttttatgcaggttttgtctatgtgataaagcgaaatggccagaaaggaggtgaataattctttaaataaaggttaacagcagcataaaaaaacgtaaacagcagccgcgctggcagcgactgcctgattatcgggagggatcagtgaagaaaatggtcaaccgcgctggttttttgcgcgtcttcttccgcgttaaacagaagctgatgcgccccggcctcaaggatcaccatagaaatctgctcttcactttggcgaacaaaccattcgaactgctcgtaggtgacgccttgcataacggataaagactggcacacaaccagttttggcagattatcatcctgcatatcgagaaaggcttttaccgtcaacgaactggcgttgatagcagagagatcggccgccagcggcagcaacgcggaaggcctgacctccgccatcgcggaaaaaagaacggtgttgtccaccaaattgattttagcatcgtagacgccgtcaaaattctgcatatgcggcaaatgcagcgcctggcaggtatcacattcgaagaaattcatgcccaggtcgtcgagccattgacgcaacgtatccagagtgggaacgaccagtgatatcataataatgtgctacctcttacgatgacgatgaaaaaattaccggcacagcttacgcaaaaagcgtgcttcgtactacggcggaatccacgattgcgattagccgccgattttaaggcaaaattcaggcgtagcgtgacgttctatccactgaatcattcgccccgcgatatccacgcccgtagtcttttcgataccttccagtcccggcgaggcattcacctccatcaccagcggcccgcgcgcggcgcgtaaaatatcgacacccgccacatccagccccagcgtctgtgcggctttgatggcgatatcccgttcacggggcgtgatcgtcgcgatgctggccaccccgccacgatgaagattggagcgaaaatcaccggctttcgcgcaccgctcaatcgccgccacaacctcattgccgacgaccagacaacgaatatcgcatcctttagcttcggcaatgtattcctgaaccaggatatgggcattcagcccccgaaacgcatcaataacgctttcagcagcctgacgcgtctccgccaataccacgccgatcccttgcgtgccttctaccagcttcacgaccagcggcgccccgccaaccatcttaataagatcgctggtatcatccggcgaatgggcgatcccggtaatggggagatcgatcccctggcgcgccagaagttgtagcgatcgcagcttatcgcgcgcgcgggtaatagcgacggattcattcagcggatagctacccagtagctcaaactgacgtagcgcagcggtaccataaaaggtaatggccgaaccaatacggggaataacggcgtcaaaatggggcagacgacgccccttgtaatggatcgacgacgctgccggattaatattcatatagcaggaaagaggatcgagtatctcgaccagatggccgcgccgcatcgccgcttcgcgcagacgtttgcaagaatagagcgttccatccctagacaatatggcaattttcaccctgcacctcgctgaaaaccctgaaaagcccgcgtatcatacactggcccgcaggttttagcgcgtcgcccagccctgtttatgcaaatattcaaggataaatgggcgattttctttaatcagggtgcgacggatatgatcgctccaggtatcgcgtcgcgtattactgccgcgggtcagataatactcagccaactgctcgtcatagcgcgccagcagcttttcatcaagcggttgatactggttctcatgaaccacaagctcggcaggcaggcgcggtttcagatccggattatccgcaggccatcccaaacacaggccaaagagcggcaatacatgcttcggcaattttaatagttcggtaacagattcaatattattacggatgccgctgatatacacgccgcctaaccccagtgattccgccgccgtcagcgcgttttgccccatcatcgccgtatcgacgacaccgagcagcagttgttcggcaagccccaactgcgcgtcaggacagatctgcaaatgacgattaaaatcggcacaaaatacccagaactcagcggcctgcgccacatgcttttgcccgcccgtcaggggcactaacgcctcgcgcagcgcccgatcggtaatacggattatagagctgcactgtaaaaaactggaactggacgtgctgcgcgcggcggcaataatggcctctcgctgcgcgtcagtcacgggttcatcggtgaaatggcgaatagaacgatggccacaaagaagttcaatggtcggactcattatgcttttctctatctgaacgggaagaaatgtcgggtggacgtttcatcaactgcggcgccagtaactgcgcaatacgccacatcatcgccaccgcggcggggaggatcaacacgacgcccaggaaaaccatcaatacgccagccagcgacgtattgaacggcgcgggcagcgtaaggtaatgattaagcgatagcagagcaagcgccagcaaaatcataccgaggcattccagtatcagtacgcttttgggtaacacgccgatcgtgcgcatatcaagcctcccggttaactgacgcacagtgtagaacgttctggtccggcgtgcttaacagatatagccctgagttatcaaaggaacaggcgtaacctgcttttcatctgccgtaaatcgcggcatgataacacctgttcgccgtctggctttatgttcgaggagagatatgtttactgttatttttggccgcccagggtgcccttattgcgtgcgtgcaaaagagttggcggaaaaactgagcaaagaacgcgacgatttcaactaccgctatattgatatccatgccgaaggcattactaaagcggatttggaaaaaaccgtaggtaaacctgtagaaaccgtaccgcagatttttgtcgatcaaaaacatatcggcggctgtacggattttgaagcatgggcaaaagaaaatctgaatcttttcgcctgattgctctggcgacgccctctgccggagggcgctatcggcgtttttttcgccggtggctaaacaggctgctaataaacaaatagcagagcgcgcctaacgcacaccagaatacggcgctaaataaccacgccagttcttgccaaaacgatcgggtaggcataaataccacgcgcattaacaccaggcaaaacggcgccgccagcatcgccccgatcagcggtcggatcacctcgcgtcggtgagaacaaaaactggccaccgcaccaagcaacgtaaaaaataacagtccaatctcaggatgccctgccgcgcgaaaagcgccttgtacatgcatagttaatgaaagacacaccacaataaagagtacaaagcagcagacaacgcttgcccacccgtgtttatgtttcaaccgttcctcctgacactctctatcgaacacgctttccgccgtgaggcatccagtcagataaagtcatgtggcattccatgccaaaaacacacctgcacaattcttatagccgttagtacgcaataagattaaactagcaggatatattgttgtgttgtttttatttggatgctgtatgcaatacgattgcacccttaattcatgataaaaacagtagcgtaaattaccatttctttcaacagcttactcgtaaacaagaagttagtctccgtgaatataaacgtcgcagatttgttaaatgggaattacatcctgttattatttgtggtcctggctcttggcctgtgtcttggcaagttacgtctgggttcagtccaacttggtaattccattggcgttttagtggtctctctattattagggcagcaacactttagtattaacaccgacgcgctaaatctgggatttatgctgtttattttttgtgtcggcgtcgaggctggccccaactttttttcgattttttttcgcgacggtaaaaattatctgatgcttgccctggtcatggtcggtagcgctctgctaatcgccttaggccttggtaagctattcggctgggatatcggcctgacggccggtatgctggccggctcaatgacatccacgcccgtgctggttggcgcaggcgataccctgcgacattccggcatcgccagcacccaactctcctccgctcttgataatctgagcctgggctatgccctgacctatctgattgggctggtcagtctgatcgtgggcgcgcgttacttgcctaaactacagcatcaggatttgcaaaccagcgcccagcaaattgctcgcgagcgcggtctggataccgatgctaatcgcaaggtttatttgccggttatccgcgcctatcgggttggcccggaactggtggcctggactgacggtaaaaacctgcgcgagctgggtatttaccgccagacaggctgctatatcgaacgtattcgtcgtaacggtattctggcgaacccggatggcgatgcggtgctgcaaatgggcgatgagattgcgctggtcggctatccggacgcgcacgccaggctcgatcccagcttccgtaatggtaaggaagtgtttgatcgcgatctgcttgatatgcgcatcgtgacggaggaaattgtggtgaaaaaccacaatgcggtcggtcgccgcctcgctcagctcaagctgaccgatcatggctgcttccttaaccgcgtcatccgcagccagatcgaaatgcctatcgacgataacgtcgtgctgaataaaggcgacgtgttacaggtgagcggcgacgccagacgcgtaaaaaccatcgccgatcgcattggttttatttcgatccatagtcaggtgacggacctgctcgccttctgcgctttttttatcatcgggttaatgatcgggatgattaccttccagttcagaaattttagtttcggcatcggcaacgcggccggattgctgttcgccgggatcatgctcggtttcctgcgcgctaaccatcctacctttggttatattccgcagggcgcgcttaacatggtgaaagaattcggcttgatggtatttatggcaggcgttggtttaagcgccggcagcggtatcagcaacggtctgggcgcggtcggcggacaaatgctgatcgccgggcttgtcgtcagcctgataccggtggtgatctgcttcttgtttggcgcttatgtgctgcgcatgaaccgggcgctgctgttcggcgccatgatgggcgcgcgtacctgcgccccggcgatggaaatcattagcgatacagcgcgcagcaatattccagcgctgggttatgcggggacttacgccatcgccaacgttctgctaacgctggcggggacgcttattgtcatcatctggccgggattaggataaaactgaagtttgcctttaagtgaaaaaattttgccaataggtcgaacttttcgttaaagcatcagtcatacctattgccactgcttttctttgatgtccccattttgtggagcccatcaaccccgccatttcggttcaaggttggtgggttttttgttgcccgacgcagagtgacacgacattgactctccggctattcgctttaccatctgtaaaatcgcttcacgcgccaacggcgttcgatccgtcacaaaatgcagcgtcatcccctcgataaacgcatccagcgcgcgggcggtctgtgcgtcaaaccactgcgccagcgtattctggctacgctgcatccagttttgcatgactatttttaacgctggcttatcgctggcataggcatataactgatacattaacgccatattatccggcgtcgtaacctgcgagccgtaaatcatttccgttatcgcctggcacgccccctccacatccgtcacctgcgcaaaaaaatcctggtattgacgcgacatgttctcggtgaaaagtgtaaaagcttcactcaataacgcatccataccggcaaaatagtaggtcatcgagccaagcggcacctgagcgatagcggcgattttccggtgcgtcacggcatgaacgccataggtctttaccgcttccagtgtggcctgaattattttttcccgtcgcttaggatcattggcgcgtcttacggcattttctttcatgatgagttccacatctcattcaggatgcaggcgatagtagcctgccgcttacgctgaaaaaacagacagcaaaaactgtctgcacaacgaagtatgacgacgatatgtacaaatgtacacaagcttgctaatgtttacctctcgcttctattttctggcctgacgctatgaccgtcctctcctcacgtaacgccttaaaacgccgtacctgggcgctgtttatgttcttctttttacccggactgctgatggcctcctgggcaacccgaacgcctgctattcgggatattctttccgtctctaccgcggaaatggggacggtcttattcgggctttctatcggttcaatgagcggtattctttgttccgcctggctggtgaaacgatttggcacccggaaggttattcacacgacgatgacctgcgcagtaaccgggatggttattcttagcgtcgcgctgtggtgcgcctcgccgctgatttttgcccttggattagccgttttcggcgccagttttggcgccgccgaagtggcgattaatgtcgaaggcgcggcggtcgaacgcgagctgaataaaaccgttctgccgatgatgcatggtttctacagtttcggcacgctggcgggcgctggtgtcggcatggcgttaaccgcattaagcgtcccggctaacatccatatcatcctcgcggctgccgtggcgatcgcgcccatttttatcgccattcgggcgatccctgacggtacgggtaaaaacgcatcggaaggttctcaccttcaggaaaaaggattacctttttatcgggacatccagcttttgcttattggcgtggtggtgctggcaatggcattcgccgaaggatctgcgaatgactggctaccgctactgatggtagacggacacggttttagcccaacctccggctctctgatctacgccggtttcacgcttggtatgaccgttggccgctttaccggcggctggtttattgaccgctatagccgggtgacggttgttcgcgccagcgcgttgatgggagcgttgggcattggcctgattatttttgtcgatagcgactgggttgccggcgtctcggtcattctttggggcttaggcgcttcgctcggcttcccgctgaccatttccgccgccagcgataccggtcccgacgcgccgacgcgcgtgagcgttgtcgccacgaccggctatctggcgtttttggtcgggccgccgctgttgggctatctgggagagcactatggattacgcagcgccatgatggttgtgctggcgctggttattctggcagcgctggtggcgaaggccgtcgccaaacctgtatcgactccgcaaccggtgatggagcataacgcatgagtattaaattaatcgccgtcgacatggacggcacttttctgagcgatcaaaaaacctataaccgtgaccggtttatggcgcagtaccaacaaatgaagcggcaaggcattcgctttgtcgtggccagcggcaaccagtattaccagttaatctccttctttccggaaattgcgcacgaaatcgcttttgtcgcggaaaacggtggctgggtggtcagcgaaggagaggatgtttttaacggcgagctggcaaaagccgacttccaggcggttgtcgaacacctgctcacacgcgccgatgtggagatcatcgcctgtggaaaaaacagcgcctacacgctgaaacggtacgacgatgcgttaaaagccgttgcggcaatgtattatcatcgtctggagtttgtggataatttcaacaatatcagcgatgtttttttcaaattcggccttaatattaccgatgaacggataccggaagtacaggcggcgctgcacgacgccattggcgatatcatggtccccgttcataccggctatggcagtattgatttaataattcccggcgtgcataaagccaacggcctgcgtctgttacagcagcgctggggcattcatgatagtgaagtggtggtattcggcgacggcggcaacgatattgagatgctgcgtcaggccgggtttagttttgccatgtcgcacgccagcgaagcggtcgcggcggcggcgaaataccgcgccggatcgaacaatcaggaaggcgtgctggatatcatcgacagcgtattaaacaacgagccgccgttcaacgtctagcggatgcctctctacgcctgataacagaaagcttatcaggcgtagccgctctctcagactgtttgcaaattccccgtccgcttatcttttaagaagaccagcatcagcagtagccaaagaataccgtttgccagattaaacaggctaaatagcccattgccgccgcttaaccaggcgtgtttactgacttcaatgccaacggtaaaaatcagcatttgtagcattcccatcgccgccgagaccgttcctttactcatatcgctggaaaagagcgtcagacgcaccagtccggcattcgccagcccaatgccaaaagcgtatacgcttaatcccgccgtcatccataaataagcatgggatgaaaccaccgtcgccgccgcggcgatgatcagccccgcgacgataggccagccgcccatcacgatcagcgagcgaaccgtacgtcgggaggttaaacgcgccaacaccagattaccggcaatgagcgcgccaaaaacgggcacctgcagcaaaccatattcatagctgctgagctgttcgccgctaatgatgataatcggcgactgcgcaatccaggccaacagcggcaggctgacaaatcccagcgctaacgcccctgcgacgaaccgccgattttttatcaccagccgataatcccggccaagcgccttaaatgacagcgtttcgccccgccgcgtggcggtctccggcattgcgcgctgtagcccgaaaaaggcgatagcggccagtgcggcaaataaaataaacatcccctcccacggcagaacatgcacccatgccgccccaactagtggtcccagtagcggcgcgattaacgccacgttcgccatcagcgcggtaatttttatacacaccgcctcctcaaaggattcctgaatcgcggcataccctacagcgccgataaaacacaggctaatcccttgcaaaaaacgcaggaatgtaaattgttcgatgtttttcgccagtaacgtcgccaggcaggtgacaataaaccacacgacgcccgccagcatcacgggacgacggccaatccggtcagacaacgggccaagcagccattgtaagaacataccgcccgccagataagcggtcatggacgtcggaacccagtccaggcccgcctgatactgctcaaccaccgccagcatacccggttggatcatgtcgttgccaatataagtagaaaactcgtacagcaccagacagagaggaaaaagcagcgcctgacgtcccagcctgccgcctgattgtaaacgattctgcataccatctcttcgccaataaaaaccgcgcagagtgtaatgaaagtcggggaactgagatagcgaattatgaggctgcaagggaaatagcgcacatttttacagaaagctgcttagcgcttgcgtactttaaggttaatttaagtttgcgccgttatcatcaacgttattttatgccattgtcttaaatctcttcatgttgccgccaaataagacaatactgcttttcctccctgttacgctgcatttatgctcagtttgcacggggatgagctggctatcccttttgatttcattgctccgagcctggatgttatgctggaaaaccttaacaactcgctgttttattttattaacgccacgcctgattccgcgcagtggataatttcgctcgctatctttatcgccaaagatgtcatcaacatcgtcccgctcttagccgtggtactctggctgtgggggccccgcgatcgggtctgcgcccagcgccagctgatcgttaaaatcggcatcgcgctgattatcagtctggcggtctcctggacaatgggacaccttttcccgcacgaccgtccgtttgtcgatcatatcggctataacttcctgcatcatgccgccgatgactcgttccccagcgatcacggtacggtgatttttacctttgcgctggcgtttttgttctggcaccgcctctggtcaggcatcgtgatgatggcgatagccatgaccatcgcctggtcgcgcgtctatctcggcgtacactggccgttagatatgattggcgcgctgctggtagcgatgcttggctgcctgagcgcacagctgatctggcaatggtacggcgcgccgctctaccaggcgctgcaacgttgttaccgtttctgtttcgcattgcccattcgaaaaggctgggtacgtgactaaatagcgaaaaaaagagtaatattaagcgctctgtatggtgcggagcgcttatttaactctccaggggaactatggaaacgcgacgcgacgagcgtattggtcaattgctgcaggccttaaaacgcagcgataaacttcatcttaaagaagccgcgaccctgttgggcgtctctgaaatgaccattcgtcgcgacctgaaccataaaagcgcgcctgtcgtgttgctgggcggctatatcgtactggagccccgcagcgccagtcattatctgttaagcgatcaaaaatctcgtctggtggaagaaaaacgccgtgccgctcagttggctgcgggcttggtacaagcgcatcagacggtatttattgactgcggcaccaccacgccgtggatcattgaagctattgataatgatcttccctttacggcggtgtgctattcacttaatacctttctggcgctgcaggacaaaccccattgccgcgccatcctcagcggcggggagtttcacgccagcaacgccattttcaaaccgcttgatttccatgaaacgttaaacaatatttgtccggatatcgcgttttattccgccgccggcgttcataccagtaaaggcgctacctgctttaatctggaagagctgccggtaaaacattgggccatgacaatggcccagagccatgtactggtggtggatcacagtaaattcggcaaggtacgtccggcgcggatgggggaattatcacgctttgatacgattatcagcgaccgccgtcccgatgaggcctttgtggcctacgctaaagcgcaacaaattactctgatgtattaaccgcaggtttgccggatgcgacgcgcacccggcaacggggttattttacgagaaccaactgccaaaccactgatggagtttcatcagcacaaaatcccacatacggctgaaaaatcccccctcctcgacgttttccatcaccattaacgggcgttgctcaatggattttccgttaagctggaaatcgatggtgccgacaacctgccctttcttcaatggcgccgtgagctgtggttcgttcaacgtaaagctggccttcaggtttttaagctgcccacgcggaatcgtcacagaccccgcatcgcccgctcccaaattgacctcacgcttatcgccaaaccagacccgttgcgtcacgaatgtcgcgtcaggtttaatcggcgtgaccgtttcaaagaagcggaaaccccaggtcagcagtttttctgactcattaaaacgaatacggtccgttttcgcccccagcacgacagagatcaggcgcatatcgccctgggtggcggaggcgacaaggttatatccagcgcctgccgttgtccccgttttcatgccgtcgacatgcagattggtactccacaacaggcggttgcggtttggctgacgaatattattaaaagtaaattctttctctttatgaatggcgtattcgtcaggcacatcgtgaatcaaggccttgccgagcagcgccatatcgcgagcggtactgaactgccctggcgcatcaaggccgtgtaccgtctggaaggttgtattggttaaccccaatcgtttcgcataggcattcatcaggccgataaaggactcctggcttccggcgacgtagtcggcaagcgcgatacaggcatcattacctgactgaatgatgatgcctttattaagatccgcaaccgacacctgatcgccgggcttcagaaacatcaccgacgacccacgtagcgccgggttccccgtcgcccaggcatctttgcccaccgtcaccatatcggtcagcttgattttgcctgccttcagcgcctggcccaccacgtagctggtcataatttttgtcaaactggcagggtcgagtttctcatcggcgttgccttccgccagtactttaccgctggcgtaatccattaagatccaggctcgcgcatcaacgcccggcggcgcgatcgtttgttcctctgcctttacaggcgaagcgaaaaggaataagagaaccgaacctgccgcgaggctacgaagggaagaagcgtattgcgtcatagtaccacccgagtatccattccaaaaacacacgtcacaccaccgtgtaataagtgcggtgagtaataacgcactcacgacgttaaagaaaccgtaacttggtaaagtttttaaagtttatgcaataacatcccgttacgcttccttcataacgatttttttacagaccattgtgtaaatgttaggtttatctcacggtaggccgattactgtcatcatcctgataaaacagaaggggttaatatgattacgctgtggggccggaacaactcgactaatgttaaaaaagtgttgtggacgcttgaagagctggaactgccatacgatcaaattctggcaggtggaaaattcggcgttaaccaggatgccgactatctggcgatgaatcctaatgggctggtgccgctgcttaaagatgatgaaaccgacctgttattgtgggaatccaatgccattgtccgctatctggcggcgcaatacggccagaaccggctatgggttgataatccggcacggcgtgcggagggcgaaaaatggatggactgggcgaatcaaacgttaagcccggcgcaccgcgtgatcctgatgggactggtcagaaccccgccggaaaaacgcgaccaggcggcaattgaagccggtatcgaaaagtgtgatagcctgtttgcgcttcttgatgatgcgctggcccaccagccgtggttctcaggggataactttggcaccggcgatatcgctattgcgcccttcgtctataacctgctgaacgtgggtctgaagtggacgccgcgcccgaatctgcaacgctggtatcaacagcttaccgagcgccctgcttttcgcaaagtggtgatgatcccggtgacctaacgcgtggctgcaggacttaccttgagtaactgcccgtcggactcatcggttaacacatataagtagccgtcaggtccgacacgcacatcccgaatacgctgctttctgtcacccagaatacggccttcttccgtcaccgtattgccatcgacgcgcatcacaatgacctctttatcttttagcgcgccgataaacagtttgtgccgccacggcgcaaaaacgtcgctggcataaaaagccatcccgctgatcgccggagaatccttccagtagtaaaccggttgctccgttccctcgacaatttcacctttggcttccggcactttcagaccactatagttgacgccccatgtggccagcggccagccataatttttgcctttttccgggatgttaatttcatcgccgccgcgcggaccgtgttcatgcagccatagcgcgccgctccagggattgatggccagcccctgcggattacgaataccgtaagaccagatttccggacgcgcgcccgcctgatgtacaaacggattatccggcggaatttcgccctgcccggtcaggcgcaccagcttaccctgtaatttatccaaatcctgcgcggtagcgcgctggttattttcacccagggcaataaaaagaaacccttgcgcatcgaataccatacgtccgccgaaatggttgccggtagacagcttaggcatctggcgaaacacggtacgaaaatgctccagacgctgaaaatcgtcgctcagccgtccaaagccggctgccgtaccggcgtttccttcgcggtcagcttcagcatagctcagccagacgcggcgcgactgggcaaaatcaggcgccagcacgacgtccagcaaacctccctgcccgtttgcccacactttcggtacgccagccagcggatcggaaagtccccgccccgtctgccagtggcgcagttgtccccctttcagggtaatgagcatcccacggttatccggcaaaaaagccagcgaccacgggtgatcgagtcgggtttgcagcacctcaacgttcaccggcgcaagattggcgttcgcccatgaagagaaaagagagaatgaaactatcgcgagaagtattcgacgcataccgcctccttcagggctctgcgttaaagcgtagtcagcatcgcaagaggtcgggtttatttttacaaaacattaagcggcgcggtccggtaaaaagggggagtcgcctcccccttattcagacctgtgtaagcggtgaatgtgctttcagactctgaatactcagcgtcaaagttgtcagacagttttcaagtttatctgcgttgacggcaataaaggtcggacaatcatggtgtccactcattaaacaaacggcggcggctgcaagcgcgccttcggcacggcgcagcgcgttccactcttcctgatcgagatgcagtccctgccgtaaagcgtgatcgtggagctcgcgattcagttcaaaaaaattgtcacgcagagtgtcactttcgctgactgacatataccccttcgcttttcgcaattgcagataagcggcaagatcgatacgcgcgtttatcagcttgttgagaagatcggttctcagtctgtcaacgaccataccttttttcctcctcttttctaccagggttcaacttaatagtatggtcgttttttagacaaaggggtgtcagagatcaagaattttcttagaattgccctttttcaccttttgctgataaccacaacggttgatgccgccgctcctgatgagattgcgatacaatttttgttcggatatctgtagaatccctgccctgaccattccaataaatgaacactttttaagctatgagtaatgtaacccaccagccaaagatcggcttcgtttccctgggctgtccgaaaaacctcgttgattcggaacgaatcctgactgagctgcgtaccgaaggctatgacgttgtgccacactatgacgatgcggatatggttatcgttaatacctgtggctttattgacagcgcggtacaagagtcactggaagccattggcgaagcgctgaacgaaaacggtaaggtaatcgtcaccggctgcctgggcgcaaaagaagatcagatccgcgaagtgcatccgaaagtactggaaatcaccgggccgcatagctatgagcaagttctgcagcacgtacatcattacgtaccgaagccgaagcacaatccatttttaagcctcgtaccggaacagggtgtaaaactgacgccgcgccattatgcgtatctgaaaatttctgaaggctgtaatcaccgctgcacgttctgcatcatcccgtcgatgcgcggggatctggtcagccgtccgattggcgacgtattaagcgaagcgaaacgtctggttgatgccggggtcaaagagattctggtgatttcgcaagatacctccgcctacggcgtagatgtgaagcaccgcaccggattccataatggcgaaccgatgaaaaccagtatggtgagcctgtgcgagcagttatcaaaactgggcgtctggacacgtctgcactacgtctacccctacccacacgttgatgatgtgattccgctaatggcggaaggcaaaatcctgccttatctggacattccgctgcaacatgccagcccgcggattcttaaactgatgaaacgtcctggttccgttgaccgccagctggcgcgcattaagcagtggcgcgaaatctgcccggaactgaccctacgctccacctttattgtcggcttccccggcgaaacggaagaagacttccagatgctgctcgacttcctgaaagaggcgcgcctcgatcgtgtaggctgcttcaagtacagcccggtggaaggcgcaggcgcgaatgagctgccggatcaggtgccggaagaggtgaaagaagagcgctggaaccgctttatgcaactgcaacagcaaatctccgctgagcgcttgcaggaaaaagtgggccgcgaaattctggtgatcgtcgatgaggttgacgaagaaggcgctatcgggcgtagcatggcggatgcgccggaaattgacggcgcggtctatttgaacggcgaaaccaacgtcaagccgggcgatatcgtgcgcgtgaaagtggaaaacgccgacgaatatgatttgtggggcagtcgggtttaacgccacttcccccggcgcgggtgccgaatgtgttaccccacctggcgagccggttccaggcccgccaggcgtcaacgccaccgggctggcttaccccttaatcttcgggtccagcgcatcgcgcaacccgtcgcctaacagattaaacgccagcacagtcaggaaaatcgccaccgccgggaagagcgccacgtgcggcgcgatgaccatatccgcccgcgcttcattaagcatcgctccccactccggcgttggcggctgcgcgcctaacccgagaaatgacaggcttgccgcggaaataattgacgtaccgatacgcatcgtaaagaaaaccacaattgacgagaccgttcccggcaagatgtggctaaacaaaatcgtcgtgtcgctggcgccgatactgcgggcagactcaataaacgtctgctgttttaagaccagggtatttccgcgcaccagacgagcaaacgccggaatagagaaaatcgccaccgcaacgatcacattagcaataccgctgcctaacaccgccacaacggcaatcgccagcaaaatgccggggaaggcgaacaacacatcgcaaatgcgcataatgaaacgatcccaccagccttcataatatcccgccagcaatcccaacaccgtgccgattatcgcgccgataaataccgcgaacacgcccgccgccagtgagatctgcgcgccaacgagaacccggctaaagatgtctcttcccagcgagtcaacgccaaaccaatgctgcaaagaggggccattgttcaggctatcgtagtcaaaatagttttccgcatcgtagggcgttagccaacgggcaaaaatcgccaccagaattaacgccagtacgaatcccccggcgaccaacgcgacatgctggcggcgaaaacgacgccagaactcccgccacggcgtgcgtatctggtcgggttttaccaccggcatagcatgtaaaatcgcctgacggcgccagttaaataatcgcatccttacttatacctgatagccggattaatggcggcatagaggacatccaccactaagttgataagaataaattccagagaaaacagcagcacttctgcctgaatcacggggtagtcgcgcatgtcgacggagtcgaccagtaatcgcccaagccccggccagttaaacactttttcgacgacgatcgatccgccaagcagaaagccaaattgcagtcccatcatggtgacgaccgggatcattgcattgcgcaggccatgttttaacaccacccacgtttcactgacgcctttcgcccgcgcggtcctcatgtaatcctcgctcagcacatcgacaaacgaggagcgcgtaaaacgcgccatgactgatgccaccgccgcgccaagcgtcagggagggtaaaatataatgttgccagctatccgcccccacggtcggtagccagcccagatccacggaaaaaatctgcattaacaacattcccagcgcaaaagccgggaaagaaatgccggtcacggcaagcgtcattcctacccggtcaggccagcgattacgccacacggcggcggcgatgccgatcgccatgccaaacaacaccgcccatatcatactggttatcgtcagccacagcgtcggcaaaaagcggctggcgatctcctcagaaaccgggcggcgggaaaccattgacgtcccgaaatcgccttgtaaaacatgggtgatgtaatgccaaaactggacatgaagcggctgatcaagccccagctgctgacgaaccagcgctatcacctgcgcgtcggcttccggtccggctatcagccgcgccgggtcgccgggcaacaaatgaacaaataaaaacaccagcactgccacaatcaacagcgtaggaattaatcccagcaggcgcttgagaacatagttaagcatcacacgaaccttttaccggatggcggacaacgcgcgcgccatccagccccatcgcattacttacttcaaatccgcatcgtcaaagctgaaaccggtatccggcataatccagaaaccggtcaaatttttactgtgcgcagaaaccaatttctccaccaccaacggtatccagggcgactctttccagataatatcctgcgcctctttgtataatcgtgttttctcctgcggatcgttagtctttaaggccgccgccaaatcgctgtcgacctgcttgttgctgtaaaaagcggtattaaactgcgtcggcggccagttttgtgatgcgaagagcggcgataacgcccagtcagcttcgcccgtcgacgccgaccagccggtatagaacattcgcacgccgctctctttttgccctttgccctcaacttccgcggcgcgctggccggcgtccatcgcggttatccgggctttaatgccaatctgcgccagttgctgttgggtaaactgcaacactttttgcgcggtgctatggttgtgcgatgaccacagcgtggtactgaaaccgtctggataccccgcctctttcaatagttcgcgcgctttagccggatcatagggccacggctgatagctttgcgcataggctatcgacggcggcaccacgcccgtcgccggcgtggcgtatccggcaaacgccactttaaccagcgcctgacgattgatagcgtaattcaacgcctcacgcaccttaggattatcaaacggcttctgcgtcacattcatactgatataacgctgcataatggacgggctggcgaccagttcgaggtttttatttttcgccagtaacgcggcctgctcataagggataggaaaagcaaattgcgcttcgccggtttgcagcatcgccgcgcgggtattgttgtcagtaaccggacgccaggtaatagaatccagcttgggtaagccctgctgccagtaaccggcgaactttttcactttgacaaagtcggtctgattccaggtttcaagctgatatggaccagtgccgaccggatgaaaaccaatatccttgccatatttttccagcgcttgcggcgagatcatcgccgtcgccgggtgcgccagaatattaatgaaagcggagaacggctgtttcagggtaatttttaccgttgccggatcgacgacctccgtttttgcgatatttttatacaggttataacgcttgaggtggttatccggattgctggcgcgatcgagattcgcttttaccgccgccgcattaaaatccgcgccgtcctgaaatttcaccccctgccgtagggtaatggtgtaggtcagaccgtcatcagaaacggtatagccttccgccaggacgttttttaccttcatgtctttatccaggccaaacagaccttgataaaatgacttcgccaccgcctgcgagagcgtatcgttggcgtcatacggatcgagcgtggtgaaattagaccctaccgccaccaccacatctttggccgccagggccggaaaagccgcaatggatgaggccagtcccagcgccgccagccatttatgcgtaataaattgcgtcatgttgttctcctgaaaccctgcctgtctgaatgttataagcgcgagagcgcattatcctgcagcggccgcgcaacataatgtcccggcccgaccaactgtaatgaaacggcgggcgtctcttcgccacgtttatgaatattgctgggtatatcatctgatagcagaacgcgccgcggccggtgtctggagggatcggcaaccggcaccgccgccatcaatttacgcgtataaggatgctgcggattttcaaaaacggcgcgccgcggccccatctcaacaatttgaccaagatacatcaccgccacgcgatggctaattcgctccacgaccgccatatcatgcgaaataaacaggtaggcgatccccatttcccgttgtaaatcgagcagtaaattaatgatctgtccgcgaacggaaacatccagcgcggagaccgcctcatcagcaataatcactttaggattcaatgccagcgcgcgagcaatgcagatgcgctgacgttgaccgccggaaaactcgtgcggataacgccaggcatgttcaggacgtaatccgacacgctcaagcaaccaggccacgcgctttgccgcagcgtccccctgccccagaccatgaatccgtaaaggttccataatggaataccccacggtctggcgcgggtcgagcgaggcgtaagggtcctggaaaatacactgaatatcgcggcgcaacggctggagtttacccgcagacagcgtgtcaatgcgctggccgttaaagataatctccccctgccgggattcaaccaaccgcagcagcgcgcgtccggtcgtcgattttccgctaccggactcgcccaccagcgatagcgtttcgccgggccagagatcgaaactgatattctcaacggcatgaacttcacgcgtaacgcggttaaagagaccgctacgcagcgggaatcgcgtcaccagcccccgaacctggagaataggttcgccttccaccaccgtgtcttgctcaatctgcgattcataaagggccggttcgtcagcggaaatcaacgggaaacggcgtggcagcgagtggcctcgcatcgcgccaagctgagggacggcggccagtaacgtttgggtataaggatgcgtcggcgcatggaaaatctgctctacgctgccggtttccacggcctcgccctgatacatcaccagcacgcgatcggcaatatccgccacgacgcccatgtcgtgagtgataaaaatcacgcccatcgacatctcttgctgcaacactttgataagttgcagaatttgcgcctggatagtgacatccagcgccgtggtgggttcatcggcaatcaataccgccggacggcaggatagcgccatcgcaatcatgactcgctggcgcatcccgccggaaagctgatgcggataacgcgataaaatcgcctgcgactccgggatccgtacctgatcgagcatacgtttcgcttccgccagcgcctcttcgtggctggccccctgatgcaaacgaatagattcggcaatttgctcgccaacggtaaataccgggttgagcgaggtcattggctcctggaaaatcatggcgatatccgcgccgcgcacacgccgcatctgcgcgtcactctgctcagacagctcaatcacctggcgattacgccgacgcaacagcatttcgccgcagcgcacgttcgcgcccgactgctcaatcagccgcattaacgccagcgccgtcaccgattttcccgagcccgactcgccgacaatcgtcagagtctctccacgcttcaggcgtaatgacacattacgcacggcgtctacctgttgcccttcgtggtgaaacgcgatattcaggccactgacggacagaacatcgcggctatccagttcatcgctgtgcggcacctgcggctccttattcccggtaaattcctgtggtaggcgtatccccggcatatccccaggcgcgatacatcccttcgctgttaaacggcaacgcgacattaccttcgtgatcaacggcgattaatccaccgctgccgcccagcgccggtaatttttccatcaccacgcgctcacaggcgtcggcaaggctgagtccgccatattccatcaatgcggcgatatcgtaagccgcgagcgtgcgaataaagacctctcccgttccggtacaggaaacggcgacgctggcgttgttggcataacacccggcgccgaccagcgggctgtcgccgacgcgcccgggcaatttattggtcatcccgccggtagacgttgccgccgccagattgccgaatttatcccgcgccaccgcgccgactgtacccatttttttcgtttcgtccagcggcgcgccgctgtgatcgagcgccatttcgcccgccgcacgcgccgccagcaattgctcgtaacgcgccggggtggaaaagatatccggcgaaacgcgcgccatcccctgtgaaaaggcaaagttttccgccccttcccccaccatgagtacatgcgggctgcgctccatcaccagtctggcggcgagcacaggatggcgaacatgactcacgcccgcgacggctccggctttcagggtattgccgtccatcacgcaggcatccagttcatgagttccgtctcgggtatagaccgcgccgatacccgcattgaagagcggacacgcttccagcaggcgcaccgcttccgtcactacatcaagcgcgctgtcacccgcttccagcatcttttgcccgctttcgacaatctctgacagcgcctggatatagcgtagctcctgctcatggctcatttgcgcgcgagcaatcgcgcctgcgccgccgtgaatcgcaatcactgctttattcatttttagggtccattaacggtggcacacaacttttactataactatcagaattgttgtgagttattcattcgatttttgaatatagaaagatgcgtaaggtatgtaaaggcgcaaggccgtctctaagactgaggtagcatactgcccgccactgttttctgacataatagccggattcgattttgcctcgcaggagtatgttcatggaattttccgccggattgatgccgcttgaaacggcgctgacccagatgctttcacgtattaccccgctcaccgccgtagaaacgttgccgctgatgaactgctttggccgcatcctggcgaccgatatcgtatctccccttgatgtccccggctttgataattcagctatggatggttatgcggtacgtgtggcggatttgtccgccgataagccgctgcccgtcgccggcaaagcatttgccggtcagccttaccaaggagaatggcctgcgggaacctgtattcgcattatgaccggcgccccggtgccggcaggttgcgaggcggtcgtcatgcaagagcagacggaacaaactgatgacggcgtgcgttttaccaccgatgttcgttgcggacaaaacatccgccgccgcggcgaggatattcgccaggatgcggtggtctttccagccggtacgcgcctgactactgccgaactgccggtgctggcgtcgctgggaattgccgatgcgcaggtagtacgtaaagtgcgcgtagcgctgttctcgaccggcgacgagctccagcttccgggccagctgctggaggcgggacaaatttatgacactaaccgtctaactatacatttgatgctgcaacagcttggctgcgaagtgatcaatttaggcattattcctgacgatcccggtaagcttcgcgccgcgtttgtcgacgccgacagccaggccgatgtagtgataagctccggcggcgtctcggttggtgaagcggactataccaaaaccatccttgaggagctgggcgaaatcgccttctggaagctggctatcaagccaggcaaaccgtttgccttcggcaagctcagtaatagctggttctgtggcctgccggggaatccagtctctgcggcgctcacgttttatcaactggttcagcccttactggcgaagcttggcggcaatacggcaagcgctgtaccgccgcgccagcgtgtacgcacaacatctcgcctgaagaaaacgccggggcgtctcgatttccagcgcggcatcctgcaacgtagcgccaacggcgaactggaggtcacgaccaccggacaccagggctcacatattttcagctcgtttaatctgggcaactgctttattgtgctggagcgtgaacgcggcaatgttgagccgggagaatgggtggaagtcgagccgtttaatgctctgttcggaggcctgtaatggcggaacttagcgaccaggagatgctgcgctataaccgacaaattattctgcgcggcttcgattttgaagggcaggaagcgttaaaagatgcgcgggtattagtggtcgggctgggcggactcggctgcgcggcaacgcagtatctggccggcgctggcgtcgggcaactgacgctactcgattttgataccgtttccgtttccaatctccagcgtcaaaccttgcacagcgacgccacggtcgggcagccaaaggtagagtccgcccgcgacgcgctggcgcgaatcaacccgcatattaccattacgcccgttaacgcgcggctggacgacgacgctatgaccagcctgattgccgggcattcgctggtgctggactgtaccgataacgttagcgtacgtaatcaacttaacgccgggtgctatatcgcgaaagtgccgctaatctccggcgcggccattcgtatggaaggacaagttaccgtctttacgtatcgggaaaacgaaccctgttaccgctgcctgagccgtctgtttggcgaaaacgctctgacctgcgtagaagctggggtgatggcgccgctgattggcgtgatcggttcgctacaggcaatggaggccattaagctactggcgcattacggtcagcctgccagcggaaaaatcgtcatgtacgatgcgatgacctgtcagttccgcgaaatgaagttgatgcgcaaccccggctgtgaggtctgcgggcagtagtcactttacggataaacataccaaagcacggtctatggccgtgctgtatcaacagataattactgccatcagacgcaaagccagcttacccaagctccgactgacgatcggctcaagcagcgcggcatcatcttaaacgccatatcacagcctcaacccgtgatgttgtacctcatttaacgcctctttgtcagaacctctccattcgttgacgcacatcaagataactttcattcgaaagtaatttaatctttacatgaaataagagaggccgtttatgatcttcaatattcagcgctattccacccacgatggccccggtatccgtaccgtagtatttctcaaaggctgttcgttgggctgtcgctggtgccagaacccggaaagccgcgcccgcgctcaggatctgttatacgacgcgcggctgtgtctcgaaggatgcgacctgtgcgcgcaagccgcgccggacgtcattgagcgcgcgctaaacggcctgctcatccatcgcgagaaactgaccgacgcccatttttccatcctggcgcattgctgccccacacaggcgttaaccgtgtgcggcgaaataaaaagcgtggatgagatcatggcgacggtactgcgcgataaacctttttacgatcgcagcggcggcggtcttacgctttccggcggcgaaccgtttatgcagccggagctggcggcagagctgtttaaagccagccatgacgccggtattcatacagcggttgagacctgtctgcatgtcccatggaaatacattgcgccctcactgccttatatcgatctgtttctggctgatttgaaacacgtcgccgacgggccgtttaagcagtggaccgatggcagcgcctcgcgggtgctggaaaatctcaggaaactcgccgccgcgggcaaaaaaatggtgattcgcgtcccgctgattcagggatttaatgccgatgaggagaccattaaagccattaccgactttgccgccgacgaactgcacgtcggggaaattcattttctgccctaccacacgctgggcatcaataaataccacttactcagtcagccctatcatgccccggataaaccactggatgcaccggcgttacttgattttgcccagaagtacgcctgccaaaaaggtttaaccgcgaccctacgaggataattatcatgacccaactgaaactggacacgctcagtgaccgcattaaggcgcacaaaaccgcgctggtacatatcgtgaaaccgccggtctgtaccgagcgcgcgcagcattataccgaaatgtatcagcaacatctggataaaccgattccggtacgccgcgcgctggcgctggcccatcacctggcggaacgcactatctggataaaacacgatgaactgatcgtcggcaaccaggcaagtgaagtccgcgccgcgccgattttcccggaatataccgtctcgtggattgaaaaagagatcgacgacctggcagaccggcccggcgcaggtttttccgtaagtgaagaaaacaaacgtattctgcacgacgtctgtccgtggtggcgcggtcaaaccgtccaggatcgctgctacggcatgtttaccgatgaacaaaaagggcttctggcgactggcattatcaaagccgaaggtaatatgacttccggtgacgcgcacctggcggtgaacttcccgctgctgctggaaaaagggcttgatgacctgcgcgataaagtcgccgagcgccgctcacgcatcaacctgaccgtgctggaagatctgcatggcgagcagttcctgaaggcgattgatattgtgctggacgcggtaagccagcatatcacgcgctttgccgcgctggcgcgccagatggcgggcgaagagtcccgtgaaagccgtcgtaaagagctacttaccatcgcggaaaactgcgaggtgatcgcccaccaaccgccgcagaccttctggcaagcactgcaattgtgctacttcatccaactgattctacaaattgagtctaacggtcactcggtgtcatttggtcgtatggaccagtatctttacccctattatcgtcgcgatgtcgaactaaaccagacgctggatcgtgagcacgccattgaactgctgcacagctgctggctgaaactgctggaagtaaacaagatccgctccggttcgcactctaaagcttccgcgggcagcccgctgtatcaaaacgtcaccattggcggtcagaatcttatcaacggtcagccaatggacgcagtgaatccgctgtcttacgctattctggagtcctgcggacgtttgcgttctacccagcccaacctcagtgtgcgttatcacgccggaatgagtaacgatttccttgacgcctgcgtccaggtcatccgctgcggctttgggatgccggcgtttaacaatgatgaaatcgtcatcccggaatttatcaagttggggatcgaaccacaggacgcttacgattacgcggcgatcggctgtatcgaaaccgccgtcggcgggaaatggggttatcgctgcaccggcatgagctttattaacttcgcccgcgtcatgctggcggcgctggaaggcggtcgcgacgccaccagcggcaaggtatttctgccgcaggaaaaggcgctctccgcaggcaactttaacaattttgacgaagtgatggccgcctgggatacccaaattcgctactacacgcgcaaatcgatcgaaattgagtatgtggtcgacaccatgctggaagagaacgtccacgatattctgtgctcagcgctggtagacgactgtattgaacgcgcgaagagtatcaagcaaggcggcgcaaaatatgactgggtatccggtctgcaggtcggtatcgccaacctgggcaacagcctcgccgccgtgaaaaaactggtcttcgaacagggcgttatcggtcaacagcagcttgccgccgcgctggccgatgactttgacgggctgccccatgagcagctgcgccagcgtctgattaacggcgcgccgaaatacggtaacgacgatgacagtgtcgataccctgctggcgcgcgcttatcagacctatattgatgagctgaagcaataccataacccgcgctatggtcgtggccctgtgggcggcaactattacgccggtacgtcctctatctcagcaaacgtgccatttggcgccgcaactatggctaccccggatggtcgcaaagcgcatacaccgctggcggaaggcgcaagccctgcatcgggtacggatcatctcggcccgacggcggtgattggttccgtaggcaaattacctaccggttccattctcggcggcgtgctgctcaatcagaaactgaacccaacgacgctggaaaacgaatccgacaaacagaaactgatggttctgctacggacgttctttgaggtgcataaaggctggcatattcagtacaacatcgtgtcacgcgaaacgctgctggatgcgaaaaaacatccggaccagtaccgcgatctggtcgtgcgtgtggcaggctactccgccttcttcaccgcgctgtcgccggacgcgcaggacgatatcatcgcccgtaccgaacatatgctgtaatttgcccaggcgccatcggcaatatgtccgaactgcctgatggcgctacgcttaacaggcctacgcaggcctgttaatcagaagggatcggtgccgtcaagcacggcctgaatgacgttgagcgcgccttgatggttattatcatcagtgtgataacgtgaaagcgctttgatattgtctgcggcattgcccatggcaaaagagtaatgcgccattttcaacatttccgcatcattaccgctgtcgccaatggcgacgacattctgtggcgacctgttccagcgctttaacagacgactgatgccattcgctttatgcagtcccgggataatcaggtcgataaaaccgaagccgctggtgacaggcttcatgatgccatccagagatacgtgcagtttgtcgataaccagcggaatttgttcatcgggcaaattcagggagaacttaaacaggatatcgtcaatgtcgtgataatcgtttaccggctgcaggcggtgataatgtttggccatcagcgccacgaaagtctcgggagcgtttttgctgacataagcgcttttcagaccgcaggcgacgaagttaagctgcttatccttcagcagttcgccaatcacaatacgcgattcatgccgggttagctctccgtgaaacaactgcttgccatgttcatacaccagcgcgccattttctgcgacgaaggaaatttcgtctttcagctcggggaagaaggagatcaactgatagtactgattaccgctggcgaccacaaattcgatattacgttttttcagttcctggtattgcgccatgaagcgtacacgatcgtactgcttggcatcgtcgagaaaagtgccgtccatatcggtaacgacaacgttaacggtcatacttaagctcctggctgtaactgcgaccagaaacattttaataacaatgtgagcagaaccacaaatttatttcgaatgaaaagtggctgaacgaaaggaatagccgcataagacattaaggcgtcctggccaccttacgttttcctctcgcttccctccttgtgcgcccctgcaatattttaaacttgcattaaccttattttaacttaaagtatcacatgtaactaattttactttcgaacgaaagatggtgaggttgatatgacgactccttttacctacgaaacgctgcccgccgacccaaaagcggccattcgtcagatgaagcaggcgctacgcgcgcaaatcggcgacgtacaggcggtgttcgaccgtttgagcgccaccatagcagcccgggtggcggaaattaacgatctgaaggcgcagggacagccggtatggccaattatcccttttagcgaactggcgacgggcaacattagcgatgctacccgcgccgaggttaagcgccgcgggtgcgcggtgattaaaggtcattttccacgcgaacaggcgctggcatgggaccagtcgatgctcgactatctggacaagaaccattttgacgaggtgtataaaggaccgggggataattttttcggtacgctgagcgcctcccggcctgaaatctatcctgtctactggtcgcaggcgcaaatgcaggcccgccaaagtgaagagatggcgctggcgcagtcgttcctcaaccgtctgtggcaggtagagcgcgacggcaagcgatggtttaatccggatatcagcatcatttacccggatcgcatccgtcgccgcccgccgggcaccacatccaaaggactgggagcgcataccgactccggcgcgctggagcgctggctgctaccagcctatcagcaggtattcgccagcgtgtttaacggcaacgtcgagcagtacgatccgtggaatgcggcgcaccgtaccgaagttgaagagtacacggtggataacaccacaaaatgctcggtatttcgcaccttccagggctggaccgcgctctccgatatgctgcccggtcaggggttgcttcatgtcgtccctattccggaggcgatggcgtatattctgctgcgcccgctgctggatgatgtcccggaagatgaattatgcggcgtcgcgccgggccgggtgctgccgatttctgaacagtggcatcctttactgatggcggcgttaaccagcattccgccgctggaagccggggattccgtgtggtggcattgcgatgtcatccactccgtcgcccccgtcgaaaatcagcagggctggggcaatgtgatgtacattcctgccgcgccaatgtgtgagaaaaatctggcctatgcgcgtaaggtgaaagcggcgctggagacaggcgcatcaccggacgatttcccgcgcgaggactatgaaaccacctgggaagggcgtttcacgctgcgcgatctgaatattcacggcaagcgggcattaggtatggacgtttgacggtcgtacagccctgcccgctcaactgcggtgtgccctttgtctgggcgcacccgtcttaccagatctacgcgccaggatacgtaggcccggtaagcacagcgccaccgggcgtcagtgtttagctttcaatccctttactacgcaaataatcgtcgtagttaccgctgaagtccaccacgcgctccggcgtaatttcaatgacgcgggttgccagcgagctgacgaactcacggtcgtgcgaaacaaagatcagcgtgccctgatacagctccagcgccatattcagcgattcgatcgactccatatccaggtggttagtcggttcgtccatgatcaggatattcggcttttgcatcatcagtttgccgaacagcatacggcccttctcgccaccggagaggactttcgcaggctttttgatatcatcctggctaaataacaggcggcccagaatactgcgcactgcctgctcgtcgtcgccttcctgtttccactgactcatccattcaaacaccgtcaggtcattttcgaattcatattcgtggtcctgcgcgtagtaaccaatacgcgcgttttccgaccatttaacggtgccgtgatcggcgtccagatcgccaaccagcgtcttcagcagcgtagatttacccacgccattggtgccgagtaccgccagcttctcgccgacttcgagcagcaaattgacatttttaaacagcggaccgttatcaaaacctttcgtcagcgcctccacttccagagcgttacggaacagttttttatcctgctcaaaacggatgaacgggttctgacggctggaggctttcacctcttccagcttgattttatcaatctgccgcgcgcgcgacgttgcctgacgcgatttagaggcattggcgctaaaacggctaacaaaagattgcagctcggcaatttgcgcttttttcttcgcattatcggccaacagacgttcacgcgcctgggtcgccgccgtcatatactcatcatagttacccggatagacgcgcaagtcaccgtaatccagatccgccatatgcgtacaaaccatgttcaggaagtgacggtcgtgcgaaatgatgatcatcgtgctatcgcgctcgttcagcacctgctccagccaacggatagtatcaatatccaggttgttggtcggttcgtcgagcaacaggatgtccggattagagaataacgcctgcgccagtagcacacgcaatttccagcctggcgcgacttcactcatcagaccgtaatgctgctccagcgggatgcccacccccaacagcagttcgcccgcacgcgcctcagcggaataaccgtccatctcgccgtattttacttccagatcggcgactttatagccgtcttcttcgctcatttccggcaaggcatagatacggtcgcgctcctgcttgacttcccacagttcgccatgccccataatgacagtatcaagtacggtgaatgtttcaaaagcgaactggtcctgacgcagcttaccgatgcgctcattcggatcgagggaaacattgcccagcgtcggctccaggtcgccgccgaggattttcataaaagtggactttccgctaccgttggcgccgatcaggccgtaacggttgccgccgccaaatttgacggaaatattttcgaacagcggcttactgccgaactgcatggtaacgttgctggaaactaacacaggcttatcctgaaaaaagatgtgacaaaccgcttattatgccacaagtctgaaataagatcgcgccctatacaaagggctacactgaaccgtaaggggaaaaaaacgtgatttcgtacacatctgaattccctgtttactggaatgcacctataatgcgctcccaacatgacagaattctcaacctactagcctgcttggcacagaatctcgcataacatgaatatgaaattaacaacgcttttcgcggcggctttcgctgtagttggtttttgtaaaacagcctcagcagtcacttacccgctgcctaccgatggtagccgtttaattgggcaaaatcaggtcatcaccgttccggagggcaatacccagccgctggagtattttgccgcggagtatcagatggggctctccaacatgctggaagccaaccctggcgtggataccttcctgccgaagggcggtaccgtgctgaatattccgcagcagctgatcctgccggataccgtacacgaaggcattatcatcaatagcgcggaaatgcgcctctattactacccgaaaggcacaaacaccgttatcgtcctgccgattgggatcggtcagttaggtaaagacacgcctatcaactggacgaccaaagttgaacgtaaaaaagccggtccgacctggacgcctacggcaaaaatgcacgctgaatatcgcgccgccggcgagccgctgcctgccgtcgtgcctgcgggcccggataacccgatgggcctgtacgcgctgtacatcggtcgcctgtatgctattcacggcaccaacgccaacttcggcatcgggcttcgcgtgagccacggctgcgtacgtctgcgcaacgacgatatcaaattcctgtttgaaaatgtgccggtcggtacccgcgtgcagtttatcgatgaaccggtaaaagccaccaccgagccggacggtagccgttacattgaggtgcataacccgctgtcaacgacggaagcgcagtttgaaggtaaggaagcggtgccgatcacgcttaataagagtatcctggccgtcaccaacgagcctgacgttgatcagaccgtcgtacaacaggcagttcaggatcgttccgggatgccggttcgtctgaactgacagactctgcctgcgaagcccgatagacactatcgggcttctcttacggcatcagttgcaataatccatatcccaccagcgccgcccatgccagcatcggcagcgaatagaaatgaaatcgccaccagattcggcgatcgttcgccatccgtaaagcaataagatttgccagcgaccccggcagcagaccaaacccgccgatattcaccgcccacgccagcaacgtcgaggccggtacatagttcagcaggagaatggtactgggcacattactgataacctgcgacaggccgatagcggttagccaaagtcccaggtgagacagtgcgccaacttggttgaaaacgccctgcaacgccggcaattgcgttagcagatggacatcaataaacatcgccataaataccagcagcagcgtccagtccacgctgactatcaccctgcgcgccagcacaataaacccagccgccaccaacaccagtccccataactcttgcctgagctccagcgcggtaagaaaaacgacatataatgccaggcaactccacaccagacggggctgccactgcggcgaacgcgtaccggtatgatactgtaacgccctacccggaaaacaaaaccagcacaggagcagtaacgtcagcatcatcatgacggcaagcggcgccatttgcccgctaaattcagcaaagcttaagccggagcgtccccacaacagaatattttgcggattaccgacaggcgtcagcagcgaaccggcgttcaccgctaacgcttcaaaaataatcaatcggttgaccggaatcgcgcacagtttttttaacgttatcgtcagcggcacaacgataaacagcgcgacatcgtttgtcagaaaggtcgacagcgccgccgcagccagcaccaggaacatcgccagttgccgctcggtatgaaatcggcgcgtcatcttgcgtcccagcacatcaaaatagccgctcagctcaacgcctttagtgagcaacattaacccactgagggtaataatggtgtgccagtcaatcgcgccaggccaggcgcggggcgcaaaaggaacaaacaggcttaacgccatccccacaatgatcaacaactgaaaaaaacggtcacgccgcagcgcccgtaaaaaggccagattcattctgcagatgttccatgctgttgcgtgaaggccaaaaaggcatctaatgtctcttggctgacatggtgttccatcccttccgcatcacgacgcgcgatttccgggcttacgcctaataccagtaaaaaattttcgacaatttgatgccgctcgcggctttcctgcgccagcttctccccttccggcgtcagaaaaacgccgcgccaggggatcatttgaataaatcctaacgatgccaggcgcttaagcattttggccacagtcggctgggagacgccgagccgcgccgccatatccacctgacgcgcttcccctacctcaataattaaatcggaaatcagctcaacgtagtcgtctatcaactcacgccgatgcgcctctctgacctgacgaaatccttcaacgtgttcttctacgttcaccaattgcgtcactttttttgttgttggcgtacctgcgcgacgacccattttgcttcctcgtttctgtgacgcgttaacgcgtcagctgacagagcgctcattgtaaaccagagttgtccgggcacaaaaaattaacgttttagcaatagctataaaacatagcctgtgctatatctgtatgtaatgcagacatccctcacggatcgatgggatagaaacatcaggaggtttatatgaacgaatttaagaggtgtatacgcgtgttcagtcactctccctttaaagtccggttaatgctgctctctatgttgtgcgatatgatcaacggcaaaccggaacaggataacccttccacgaaataacgcggcggtgcggtacgccgctttattttgcatcctcaacggaaatggcgcccatttcccctgttttttttgtggttttgctattctcttcgcaaaacattttctttccggcggttggccttcttacccgcacgctctatcttctggcagccttgaatattttgcgactcgccgttgcgaacccaataccttttttacgcataatcaggcaggtaatgacccttcgcgccagggttagcacatggcgtttttgcaatagtggcatatgaattcaacccttatcgattcacttctggcccgtcgtcgggctgtaagcccatgggcgggcctctactttttacagtcgctgctgattaacctcgcgctcggctacccctttagcctgctttataccgcggcgtttacctgcctgttgctgctgctctggcgctacctgcctcgcggacaaaaagcgctgctcggcatctgttcgctggtagccgcttgctattttccctttggccaggcttacggcgcgccgaactttaatacgctgctggcgctgcactccaccaatatggaagagtcgagcgaaatcctgaccatcttcccgtggtatagctacctgaccggactttttatttttgcgctgggtattattgcgcttcgccgccgaaaagaagaggtcaggccgcgctggaatagcctcgacagcctgtgcctgctgattagcgtcgcggcatttttcgtcgcgccggtacaaaatctggcctggggcggcgtttttaaggttattgataccggctatccggtttttcgcttcgccaaagacgttatcgtcaataacaacgaagtcattgaagagcagcaccgtatggcgcagctatccggcataaaagatagctggacggttactgcggtgaaacccagatatcacatctatgtcgtggtgattggtgaaagcgcgcgacgggatgccatgggcgctttcggcggccactgggataatacccccttcgccagccatgtgaatggcgacttctttatggattacatcgccgccagcggctcaacgcaaaaatcgctcggtttaacgctcaatcgcgtggtggataacaaaccgcagtatcaggataacttcgtcacgctggctaaccgcgccggttttcagacatggtggttttccaatcaggggcaaatcggcgaatacgacacggccatcgccagtatcgccaaacgcgccgatgaagcgcatttcctgaaaaacggcgattttgaagcggataaaaatactcgcgacgacgcgctgttaaccatgacggcgcaggtattggcgacagaacgcacgcaaccgcagttgattgtgttgcatttaatgggatcgcatccccaggcctgcgaccgtactcatggaaaatacgcgacgtttgtccagtcgaaagagacgtcttgttatttatacaccatgacgcaaaccgacgatttgctccgtcagctctatactcagcttcgtcatagcggcgacagtttttcgctcgtctatttctccgatcacaggctggcgtttaaagagcgcggcaaagcggtacagtacctggcgcatgacgacaaattccagcaaaacttccaggtgccgtttatggtgctatccagcgacagtaaagcgcatcggatcattaaagctcgccgttccgcgaacgatttcctgagttttttctcgcaatggacaggaattagcgctaaagagatcaaaaatcgctatcgatttatttcggaacagaaagccgggcccgtttatatcaccaatttcaaattacagaaagtggactataaccatctgggcagcgatattttttcactaaaataatgcacgtttcaggcaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaaatccgccccgaaaggcggatttttcattttcaccgacgtgattagaagcggtaacctacgccagcaatccaggtgccaacgtcaacgctacgaatacggctctgctcgtaagagaagtccagagcaacattttccatcgggttgaattgcagaccagcgccataggagaagccataatcgctggtgtcatgtttgtaggttgggtaatcggtcgtctggaatttaccgtaacccacaccgactacaccgtagatgctcgcccaatcgttcagacggtaagccgggccggcagtgatgccgtagtactgacctttattgtaatcgcccgcaccgttagtacgatctttttcggtgtaggtgaaggaaccgattacacccagcgggttgtcgtcctgctcgtaacgatacttcaggttgaaaccgctcattttattcgctacgccctgcgcgtcgctctgagcgtaaccaccggtaacagtagaagtagcagctactgcagtacctgcggaaaaagccagaacagcggccagtgctgaaagacatgcaatttttttcataaccacctcaaatgtgcttcaagtaagtcctaagttttaaatatatcaaaaattaatgggaaactctttgcgattcacggtgtctaagggcgcctttcatgtaacagaacgtttccataacgcgctatcttattcaattaacatcatttttccggctgattgcaccaataatgcgcgtgtggcgcgatacattcatccagattattcctaaactaacagtctatttatccatcaatttaagttcattttatggaatcctggaaatttttttttcaacgaatcctcaaccgctccggggaatttccattacactgccacctttactcgtactgacattttttgacaggagaaaggatgccggggtcaacacgtaaactaccagtctggttgcccattttggttttgctcattgccatgtcctctattcagagtggcgcttcactggcaaaatcgttatttcctcttgttggcgcgccgggtgtaacggcgcttcgtctggcgttgggaacgcttatccttatcgcctttttcaaaccctggcgtttgcgttttgccaaagagcagcggctgcctttactgttttatggtctgtcgctgggcgggatgaactatctattctatctgtcgattcagacggtgccgttgggtattgcggtcgcgctggaatttaccggccctctggcggtcgcgctgttttcatcccggcgtccggtagattttatttgggtcgtactggctgtgcttggactctggttcctgctgccattaggacaagatatgtctcacgtcgatcttaccggggccgcgttagcgctcggcgctggcgcctgttgggctgtctatattcttaccggccagcgagcaggcgcggaacatggtccggccacggtggcggtaggctcgctgattaccgccatcattttcgtgccgattggcgcagttcaggctggcgatgcgctatggcactggtcgattcttcccttagggttagcggtcgctgtgctttctacggcgctgccttattcactggaaatgattgcgctgacgcgcctgccaactcgcaccttcggtacgctgatgagcatggaacccgtgctggccgccatttccgggatgatttttctgggcgaaacgcttacgggcatacaaatcctggccctgtgcgccatcattgccgcctcaatgggttctaccctaacgattcgccgcgaaccgcaaattaaacaagttgacgtaaaatagtttcttattctgcatgatgtgcataatcatgcagaatatcacctcgttattcaccttttattatcgcgctattacttcgtcattttttgtcatattttttctcattttttacattaaaatgagaattattacccatcaaacaacaaactcatctaaccaattgattcataaccaaaataaatattaaatcttgtctgtactattaaagtgataggtaaattcaaaaaagcgaagttaaaaaccggtgctatacttattttcgttaattacctgggacacaaacatcaagaggatatgagattatgagtaccgctaaactggtaaaaacaaaagcgtctaatctgctttatacccgtaacgatgtatcagagagcgataaaaaagcgacggttgagttgcttaatcgtcaggtgatccagttcattgacctgtcgctgatcacgaaacaggcccactggaacatgcgcggtgctaactttattgccgttcatgagatgctggatggcttccgtaccgcactgaccgatcatctggatactatggccgagcgcgccgtacagcttggcggtgtggcgttaggcaccacgcaagttatcaacagcaaaactccactgaaaagctatccgctcgacatccataacgtgcaggatcacttaaaagaactggccgatcgctacgctgttgtcgctaatgatgttcgcaaagctatcggtgaagccaaagatgaagacactgccgatatctttaccgccgcatcacgcgacctcgataaattcctgtggtttatcgaatccaacatcgaataaatctatctctaccctgaatacttcgagttgcaggaaggtacaaacgcagcgaatccgcaggagcctgacttccgtcggtcactgaagcgaacgcacctgcaacttgatgtacacaggtatataagtcatccctatacccctgcctggcacaggggttttgcacttaaatagtgcacatgtcttgtacttcccttcgataaaagtgaattatttgtaataattacatcacacaatcgttaattaaagattgttttaacaacaatttttacgctaaatagaccctgtatctctactttgttattcatgcactaaatcagtgccccaaaacagtgcagcatactggttttgcccgacttattgtgcacaggaatgattgacgcttctgttaaaacaatgagttacataattggcatgattttttcattacgctacatgttctcgcaggggatcgccccgtggatagaaaaggaaatgctatgaagtctctattaaaagtttcactggctgcacttaccctggcttttgcggtgtcttcgcacgctgcggataagaaactcgttgtggcaaccgatacggcgttcgttccgtttgaatttaaacagggcgacaaatacgtcggttttgatgttgatctgtgggacgctatcgcgaaagaactgaagctggactacaccctgaaaccgatggatttcagcggcattattccggcattacaaaccaaaaatatcgatctggcgctggcgggtattacgattacggacgagcgtaaaaaagcgatcgacttttccgatggctattacaaaagcggtctgctcgtgatggtgaaagccaacaataacgatattaaaagcgttaaagacctcgatggcaaagtcgttgccgtgaagagcggaaccgggtcggtggattacgcgaaagcgaatatcaaaaccaaagacctgcgtcagttcccgaacattgataacgcgtacatggaattaggcaccaaccgcgcagacgccgttctgcacgatacgccgaacatcctgtactttatcaaaaccgcaggcaacggccagttcaaggcggtaggcgaatcgctggaagcacagcaatacggagttgccttcccgaaaggcagcgatgaactgcgcgagaaagtcaacggcgcgctgaaaacgctgcgtgagaatggcacctataacgaaatctacaaaaaatggttcggtacagaacctaaataaaacgacctgatgttggcttgtggcccggtagtgaggacgctcaccgggcctacagctcttttccgtgacggataagacactttcacgccatttccgcgccggatagagcatttgactatttacaccacggtaacaggaacgacatatgcagtttgactggagcgccatctggcccgccattccgcttttgcttgagggcgctaaaatgaccctgtggatctcggtcctcggtctggctggcggcctggttattggactggcggcaggttttgcccgtacgtttggcggctggttcgctaaccacatcgccctggttttcattgaaattattcgcggcacgcctatcgttgtccaggtcatgtttatctactttgccctgccgatggcatttaatgatttgcgtattgatccgttcagcgcagcggtcgtgacaattatgattaactccggcgcttatatcgcggaaattactcgtggcgcagtactatccattcacaaaggttttcgcgaagcaggtctggcgctgggcctttctcgccgggaaaccatccgccatgttattttaccgcttgctctgcgccgtatgctgccgccgctgggcaaccagtggatcattagcatcaaagacacctcgttgtttattgttatcggcgtagccgagctgacccgtcagggccaggaaattattgccggtaactttcgcgccctggaaatctggagcgccgtggccgtcttctatttgatcattacgctggtgctgagctttattttgcgtcgtcttgaaagaaggatgaaaatcctgtgattgaatttaaaaacgtctccaagcactttggccccacccaggtgctgcataacattgatttaaacatccgtcagggcgaagtggttgtgattatcggcccttccggttcgggtaaatccacgttattacgctgtatcaataaactggaagagatcacctccggcgatctgattgtcgatggtctgaaagtcaacgatccgaaagtagacgaacggctgattcgccaggaagccggcatggtgtttcaacagttttatctgttcccgcatctgaccgcgctcgaaaacgtgatgttcggtcctctgcgcgtgcgcggcgtaaagaaagaagaagcggaaaaacaggcgaaagctctgttagcgaaagttggactggcggaacgggcgcaccactacccctccgagctttccggaggtcaacaacagcgcgtcgccattgcccgagcgctggccgtgaagccgaaaatgatgctctttgacgagccaacctccgctctggaccctgaactgcgccatgaagtgctgaaagtcatgcaggatctggcggaagaaggcatgaccatggtcattgtcactcacgaaatcggctttgccgaaaaagtcgcctcacggctgattttcatcgataaaggccgtattgccgaagatggcagtccgcaggcgttgatcgaaaacccgccaagcccacgtttacaggaatttttacagcacgtctcctgagatatcgcccttcctgccctgcggcaggaagggcatcatggaatagtcccatttcattttccctcccctgcgccatctatacttagtgttttgcgtctcttttctcactggaggagtcatgcggtggaccctgttcatccttttttgtctactgggcgcgcctgcccatgcggtcgccatacccggcgtgaccacggggacatcaaccagccagcaagcagcgccagagcccagtcctgaacaaaaaaaagcggcctatgcggccctggctgacgtactggagaacgaggcttcacgtaacgaattgatagcgcaactccgcgaagcctcaaccacgccgccgaccgagccagcgccagcgcttgccccgcctgcggccaaagatgagaaaacggtactggagaacgtcaccaccgttacccgtcagtacggcgatgctttcgctacccgtttcgcccagctttatcgcaacatcaccgatgcgccgtacaagccgtttaactcgcaaaccttcaccaacgcgttaacccactttttatttctggccgtcgcggtatttggtttttatagcgtgatacggctttgcgccctgccgttatatcgaaaaatgggcctgtgggcgcgcaagaaaaaccgtgaacgcagcaactggttacagctcccggcgatgatcgccggcgcgtttattatcgacctgctgctactggcgctcaccttatttatcggtcagatgctcagtgataatttccatgccggaagtcgaactatcgcttttcagcaaagcctgttcctgaatgccttcgcgctgatagagttctttaaagcgattctgcggcttattttttgccctaatgtaccggaattacgcccattcgcgattcaggatgcgacagcgcgttactggaatcgccgtatgagttcccttagcagtttgattggctacgggctgattgttgccgttccgattatttccaaccaggtgaatgttcaggtcggggcgatggcgaacgtggcgatcatgctctgcatcaccatctgggcgctgtacctgatctttaaaaacaaagcggagattacgcaacatttattaagtctggcggaacgatcattagccttttttagcctgtttatccgcgcctttgcgctggtgtggcactggctggccagcgcttactttatcgtgctgtttttcttctcgttattcgacccaggcaatagcctgaagtttatgatgggcgcgaccgtgcgcagtctggcgattattggcatcgccgcgtttatctccggtatgtttacccgctggatagcgaaaaccatcaccctgtcgccccatacgcagcgcaattacccggaattacaaaagcggcttaacggctggctctcctcggcgctaaaagtcgcacgctttttgaccgtctgcgtcgccgttatgctgttgctcaacgcctgggggctattcgatttctggcactggctacattatggcgcgggggaaaagatggtcgatatcctcatccgtatcgcgttaatcttattcttctccgccgtgggatggacgattctcgccagtctgattgagaatcgcctggcctccgatattcatagtcgcccgctacccagcgcccgcacgcgcacgctgctgacgctgttccgcaatgcgctggcagtgattatcagtaccataaccatcatgatcgtgttatcggaaatcggcgtcaatatcgcgccgttgctggctggcgcgggggcgttaggtctggctatctctttcggttcgcaaaccctggtgaaagatattattaccggcgtttttattcagtttgaaaacgggatgaataccggcgacttagtcaccataggcccgctgatggggacggtcgaaagaatgtcgattcgttccgtcggcgtgcggcaggataccggggcataccatattatcccgtggtcctcgatcaccactttcgccaactttgtgcgcggtatcggctctgttgtcgccaactatgacgtggatcgccatgaggatgcggataaagcgaatcaggcgctgaaagacgcggtaacggcgctgatggagacggaggatattcgcgggctgattatcggcgaacccacgttcgccggtattgtcggtttaacgaacacggcgtttactttacgcgtgtcgttcaccacgctaccgctcaagcagtggacggtgcgttttgcccttgatagccaggtgaaaaagcattttgatctggccaatgttcgcgcgccggtgcaaacgtatcaggttctgcccgcccccgccggcggcccgccgcctgattcactgccgccgcgcgaaccgacgatttagcgtttacgggtgataaaacggcgacgctggtcgtcatccataaaggtccaggcgataaagcggctttgcttttgctcctgggccatctcttttttcaccactttcaccgcgccagcctccgtcaacgcccggtaaagcggtggtaaattctcgccgcgcgacaccaacgtcgtaaaccacaacacctgacggcggaaggtttggctttcagcaatcatttttttaataaaggcgacttcgccgccttcgcaccatagctcctgctgttgaccgccaaagttcagcgcatcatctttattctgccccaaattgcggcgcttacgctcgctgcccgcgcgggctgcggcggcggagtcgtgaaaaggcgggttacaaagcgttgcgtcataaaattcatttttatgaataataccggtaaaaatggccgccggatctttttgccgacgcagacgaatggcgcggcttaaccccgtattagcctgaatgatagcctgcgcgctggacatcgctgcgtcgctgacttcactaccggtaaatcgccagccatattcatggacgccgataagcggataaatacaattggcgcccacgtccagaatagttgcctgcgccggaatactccctgttgtttcgccaagcagatccgccagatgatggatataatccgcacgaccaggcactggcggacataaaaaccctggcggaatgtcccagtgtgtaacggcataaaaatgcgccaacaacgccttattgagcgcttttaccgcttgcggattagcaaaatcaacgctctgttcaccggcgggcgtgcggataagataaggacgtcaattccggcgtggtctgacacagtgcggcgagatcataacggtgttgatggcggttgcgcgggtgtaaccccggtttctgggcggacatggcattctccttttagcagcggcgtaagatacccgtataacgccacggggtaaatataccaccgcgaattccctgcctcgctcgttttatcggctctctgaatgacattggctctgctcatggtctgaaaagatcgcgcgatgcgattttttcacctgacggcgctacacttaacctcaggtaccctaaaatcaggagagcgtgatggcatccggctgggcaaatgacgacgcagtgaatgaacaaatcaacaataccattgaagatgccgttgcccgcgctcgcggcgaacttccccacggcgaaagtcgcgatgaatgcgaatcttgcggcgatcctatccctgaagcgcggcgtaaagccgtaccgggcgttcggttatgcatatcctgccaacaggagaaagatttacataacgcaacattttcaggatataatcgtagaggttcaaaagacagtcagttacgctgacttttctttaccgaaaccgccagtatcatccattcctttacgctcatgctttttagcgttctgcgtcgcagaatgtgccgttaacctcgactctgtaaagccagatgacaagaacggtaaattccaccgttgaattaattaataatcaataggttatttgtcattcaaaaattttgagcaaggccgtcaattctattcgattttatctttcgcaaaaaaccgtgatactcatcacatcgacggaacatcgtcccataaacagaataacctgcgagagattaatcatgaaaaccattaaatatgctgttgcagccatcgcgctttccaccctttcttttggcgcttttgccgcagaaccggttagcgcgtctcagacgcaaaacctgcataaaatcggcgtagtgtctgccgatggcgccaccacgctggatggcctggaagctaaactggctgaaaaagccgccgctgctggcgcaagcgcttataacatcacctccgccgtaggtaatgacaaaatgagcggcactgcggtgatttataaataatttacctgcccgccagatttcaggctgtaacatcgctgttgtttgaattctgacgggtattaccctcgtctgtttgccaacagacccactgctccaaccctcattaaccctgtttgttacccttatttgcccgtccgccactggacgggctttttttattcgctaaaagcctgttcgacgcgcgcaagcccgtcttctaacgtcgccgcctctcccgtcgcaaccagacaacaggccatttgcgtttttaatgattgcggcaccggctcgtggccggcaaggcagcgctcaatccagcgcgcggtgatttcaggatctttagtcgcaggcagtgaaagcggctcgtcgtacgtgtcgctctggcgctcatgcagtacctgcacgccgcggctatcaatcaggctgatttgcggacagcgttgcgggttggcatagacttcgccttcggtaccatgcatcagcaaagcccacccgccaatgcggctaaaaaaggtcgccacacgcagaacatattcaggatgagaaacgcttgataaacgcagcgcggcatcctcagcaaatggcgtcgccagcttggccagtgaatgcgcgctgttacgcacgcccatccgccagcgcatcgctagctgtttttccagcggcgggcagagcgcgctcaccgggataaacaccggctggcgcccgtccagtttggcctgcgcttgtccgccgtgtagggtgggttcaatccccatcagctcaaatatagtttccgtcagtacgcgggtcggatcttcactgacgccgtgtactacgactggaaagcccaatttatgcagcaagatagccagcagcggcgttaaattcgcctgtttacgcgcgccgttatagctgggaataacgaccggcaacggcctatctgcgggcggtgtcagtttgatggcatgattctacatggcttcataaaagcccagcatttcggcttcgccttcgcctttaatacgcagcgccatcaatatactgcccatttccaggtcggggacgtcgccattcagcattcgggtatacaaaccgcgcgcggtatccagatccagatcgcgggcgtgatttttacctcgcccgatctctttgatgatcttgcgataatccattgaaagctccttgaagtgtgctcacagcattaacaccgtcggcggcgtgcaggttttgcttttggttttactataacgtctggcacggcaggctgctctatcggaaaaacaggtaaggcattcagtaaacgctgtccgtagtttttggtcaacaaccgcttatcataaatgaccacttctccccgacaggcgtggctacggatcaatcgccctacctgctgaattaaattaaaagacgcgcttggtaagctttgtacctcaaacggataacgattcagactttttagccattcgccttcggtgatcacgaccgggctgtcgatcggcgggaaggcaattttatggatatggacctgcgtcagtagctcgcctttaagatccagcccttcggcaaaagactgaagcccaaccagcacgctgcgttcgccgctctccacccgtttacggtgcagctccaccagccggtaacgcggctggtcgccctggaccaggaggagtaagcgcacatcagcgacatgctccagaaaacgctgcatcgcccgcccgctggcgaacagtaccagcataccatgatgttttttgctctccagttgctcgcgaaaataggctgccatttcggcaatatgctgctcttcgttatcaatagtgggttcgtagcgcatttgaggaatcaccagtttcccctgttccacatgattaaacggcgaatccagcgccacaaagcggtcgccggctttttcttttaagccgctcatttcctgcaggcgcgaaaagctattgagcgagcgcagtgtcgccgaggtgacaataatgtgcggtacgctgcgccataacaatctttccagctgctcgctgacgcggataccgacacaatggaaccagacgtggagttgcccttcgcgtatttcacgcgtcgcccatttggacaccggcgcgcctgaagactgcgccatcgaagccagtcaccataatttactttgcgcctcgaacattcccagcgcccggttcatctgtaaaatcacccgatgcaaacgcacaatatcgtgcgacccggttttttcgctgagatcgttgagaaaggactccgccagcccacgcaacgtctcggtcagcttcgccagtcgctggcagatttccatgacctcatcaggcaactcgcccattgcaaaacggtgctccgcctcctgcgctgcgggcatatacagattaagaatggcattgagcgaggcgatcagttcgtacacctcctcgcaatgggcgttaagtcgctcaggattcgctaacggcggcgtggtcttagggcgaaattgctccatgcaggtcgccaccagtttgctgaacaggtccagttgcaagcgataccaggaggcggtaatttccgcgctcatctccagcgcatcgcgagcgacatcgggcagatgatgaccttcatccagtaccaacagcagatgctttggttccggcagtacggcttcactttccatcgccgccattactagcgcgtgattcgccaccacgacttccgcttcctgtatttcacgtcgggcgacaaagaatggacattcgcggtaatagtgacagttgcggttcagacaactggctttatcggtacttaatcgccgccacagatcgtcgtcaatagcaatgtcggtatgatcccgcagaccatcccatttgtaaccgtcaagatcccctttcagcctggcgcagcgcttttgctcttcctggttgttaggcgtcagttcgtcatcaagaaaggcgagcagatcctgctgcgtaggctcgctactggcgagcgccgccaggtttcgcggacacacgtaacgcccgcggccaaaggcggcggtaaagcgcagatcggggatgatttttcgtagcagcggcaaatctttgctaaagatctgatcctgtaacgccacgttagcggtactgaccaccagtgttttttgctcttcccgggcaatggcgataccgggaataagataggagagggttttcccgacgccggtcggcgcttcaatagccagatgtctcccttcttccccggccagcgttctggcgacgtcagcaatcatctgccgctgcggcgcacggggaataaagtcgggaatctgatcctgaagcgccttataccaggcggcgatttgcgctttcagcgcagcggtcaatgccatgagaaaacctgaagtactgtataaacagccactattgtgtcacatttcaggggcgggaagtaccttttttgccggttctggaaggcggctcgcaacgcgatgtgtattttgccggatggcggcgcaagcaccttacccggcctacgtatttgcatagtccgtaggcccggtaagcgtcgcgctaccgggcatgttgccggataaaatttactgggcaggcgtgattctgcgcgggcgacgcggcggacgtgctttgtcgccagcgggtttcccctcgcctgtgcgcggttttggtttcgccttcgccgccccgctatcctgacgtcgcggctgctgactgcgccccgctcccccctgattttgtccgcgtccacgaccgccgccaccgccgccgcgctgctgacggccgttctgaatcggctccgctttaatcgacgggtccggctcatagcccggcgtcgtaatgcgtgggatctcttttttcagcaatttttcgatatcacgcaacagtttatgctcgtcaacacagaccagcgacagcgcctcgccagttgccgccgcgcgaccggtacggccaatacggtgtacataatcttccggcacgttcggcagttcatagttgaccacgtgcggcagctcttcaatatccagaccacgcgccgcaatatccgtcgccaccagcacgcgaatatcgccggatttaaaatcggccagcgcgcgggtacgtgcgccctgcgatttattaccgtggatcgccgcgctgcgaataccgtctttattaagctgttccgccagatggttcgcgccatgcttggtgcgggtgaagaccaacacctgctgccagttgccctggccaatcatctgcgacaacagttcacgtttgcgttttttatcgacaaagtgcacgtgctgcgtcacctgctctgaggccgtgttgcggcgcgccacttcgatttccagcgggttgcgcaacagcttttcggcgagcgctttgatgtcgtcggagaacgtggcggagaacagcagattctgacgcttcgccggcagtttcgccagcacgcgacgaatgtcgtgaatgaagcccatatccagcatacggtcggcttcatccagtaccagaatctcaatctgatccagcttcacggcattttgatgttccaggtcgagcagacgtcccggcgtcgccaccagcacatccacgccgccgcgcagtttcatcatctgcggattaatgcttacgccgccaaataccaccagcgagcgaatattgagatatttactgtaatctctgacgttttcaccaatttgcgccgccagctcgcgggttggcgtgaggatcaacgcacgtaccgggcgacgacctttagcgtgcggctgatgggtaatcagatgctgcaacaatggcagggtaaaacccgccgttttaccggttccggtctgggcgctagccatcagatcgcggccttccagcacggcgggaatcgcctgttgctgaataggggtaggttcacggtaaccctgctcggcaatggcgcgcaggatatcagggtttaatcccagggaatcaaaagacataactactccggaccgccccgaccgttaccggtgtagttttcagggagatgctcaaatttggaatgacaaaaaccacaatgtcatgaaggggcggagtgtagcagtttttgtgatgcggcgcataaattatcccgaaaggtggcaaagacaaattaatcgaccacactggacaagtgccattatgagtcataatcttaatcaatcgattgattaataattagggcgtgtgatgaatattcccaccacgaccaccaagggcgagcaggcgaaaagtcagctcattgccgccgcactggcgcagtttggcgagtatggcctccatgccaccacgcgcgatatcgccgcgctggcggggcaaaatattgccgctattacttactatttcggctcaaaagaggatttatacctcgcctgcgcccagtggattgctgattttcttggcgaaaaatttcgcccccatgctgaaaaagcggaacgtctgtttagccagcctgcccctgaccgagacgccatacgcgagctcattctgctcgcctgcaagaacatgattatgctgctgacgcaggaagacaccgttaacctgagcaaatttatttcacgcgagcagctctctcccacatcggcctatcaattggtccatgaacaggttatcgatccgttgcacacctatctgacaagattggttgccgcttataccggctgcgacgccaatgatacgcgcatgattttgcatacccatgccttactgggcgaagtactagcgtttcgtctcggcaaagaaactattctgttacgtaccggctggccgcagtttgatgaagaaaaagcggagctgatttaccagacggtaacctgccacatcgatcttattctgcacggtttaacgcaaaggagtctggactgatgaaaaaacctgtcgttatcggactggtaatcgcagcgatcgtcgctgtgattgccggtggaacctggtggtatcaaagtcggcaggacgatgggctgacgctatacggtaatgtcgatatccgtaccgtcaatatcagctttcgcgtcggcggcaggctggcgtcgctgaatgttgatgaaggcgatactatcaaagccggacaggtgctcggcgaactggatcacgcgccatacgaaaacgcgctgatgcaggcgaaagctggcgtgtcggtcgcgcaggcgcaatatgatttgatgctggcaggctatcgcgatgaagagatagcccaggccgccgccgccgtcagacaggcgcaagccgcctatgactacgcgcaaaacttttataaccgtcagcaaggattgtggaaaagccgcaccatttccgctaacgatctggaaaatgcccgctcatcgcgcgatcaggcgcaggcgacgctgaagtccgcgcaggataaactgagccagtaccgtaccggtaatcgtgaacaggatatcgcccaggcgaaagccagtctggaacaggcaaaggcccaactggcgcaggcgcagcttgatttgcaggacaccacgcttatcgcgcctgccaacggaaccttgctcacccgcgcggtcgagcctggcagtatgctgaacgccggcagcacggtattaacactctcgctgacccgccccgtctgggtgcgcgcctatgtcgatgaacgcaacctcagtcagacgcaaccggggcgcgatattctgctgtataccgatggacgtcctgacaaaccttaccacggcaagattggtttcgtttcccccaccgcggaatttacgccgaaaaccgtcgaaacgccggatctgcgtaccgatctcgtctatcgcctgcgcattatcgtcaccgatgcggacgatgcgttacgccaggggatgccagtcacggtgaaatttaatgacgaggcacggcatgagtgaggccgttattacgctgaacggtctgacgaagcgctttgcgggaatggataaacccgccgtcgcgccgctcgactgtaccattcattccggttatgtcaccgggctggtagggccggacggcgcaggaaaaaccacgctgatgcgtatgctggcgggccagctcaaagccgatggcggcagcgcgtccgtattgggcttcgacccgatacaaaacgacagcgagctgcacgcggttctgggctatatgccgcagaaattcgggctgtatgaagatcttaccgtcatggagaaccttaatctctatgccgatttgcgcagcgttaccggcgagatacgggaaaagacctttgcccgtttgttggagtttaccgccctcggccctttcactggccgtctggcgggaaaattgtccggcgggatgaagcaaaaactggggctggcctgtacgctggtcggcgaaccgaaagtgctgctgttggatgaaccgggcgttggcgttgacccgatttcacggcgcgagttgtggcaaatggtccacgaactggcgggcgacgggatgctgattttatggagcacctcctatctggatgaagccgaacagtgtcgcgatgtgctgctgatgaatgaaggcgagctgctctatcagggcgaacctaaagcgctgacgcaaacgatggccggtcgtagctttctgatgagtagtccacaggaaaacaaccgtaagttactacagagagcgctcagactgccgcaggtgagcgacggcatgattcaggggcgttcggtacgcctgatcctgaaaaaagaggcgaccgcagcagatattcgtcaggccgaagggatgccggaaatcaccctcaatgagaccgcgccgcgtttcgaagatgcgtttatcgatctgcttggcggagcgggaacctcggagtctccgctgggttcaatcctgcatacggttgaaggcactgccggcgaaacggtgattgaagcgcaggaactgacgaaaaaatttggcgatttcgcggccacggaccatgttaatttcgtcgtacaacgcggcgagatttttggcctgctcggcccgaacggcgcgggtaaatcaaccacctttaaaatgatgtgcggcctgctggtgccgacgtccggcaaggcgctggtgctggatatggacctgaaagtcagctccggcaaagcccgtcagcatctgggctatatggcgcaaaaattttcgctttacggcaacctgacggttgagcagaacctgcgttttttctccggcgtctacggtttgcggggccgcgcgcaaaatgaaaaaattcagcgcatgagtgaagcatttggtctgaaaagcatcgcgtcgcatcccaccgatgcgctgccgctgggttttaaacagcgactggcgctggcctgctcgctgatgcacgaaccggatattttattccttgatgaaccaacgtccggggttgatcccctcacccgccgtgaattttggctgcacattaatagcatggtggaaaaaggggtcacggtaatggtgacgacccactttatggatgaggcggaatattgcgatcgcatcggactggtttatcgtgggaagcttatcgccagcggtacgccggacgatctcaaagcgcaggccgccgatgagcaacaggccgatccgacgatggagcaggcctttatcactctcatcaatgactgggataaggagcatacgcatgagtaagtctctctcctggcgccgcgtgcgtgcgttgtgcgtcaaagagacgcgccagatcgtgcgcgatcccagtagctggctgattgcggtggtgatcccgctgctgttgctgtttatttttggttacggcattaacctcgactccagcaagctgcgggtggggattctgcttgaacagcaaagccaggaggcgctggatttcactcatgcgatgaccggttcaccctatatcgacgcgaccattagcgataatcgtcatgaattaattgaaaaaatgcaggccggacgcattcgcggactggtggtgattccggtggatttcgcgcagcaaatggcgcgcgacggtgacagcgcgccgattcaggtgattaccgacggcagcgagccaaataccgccaacttcgttcagggctatgttgaaggcatctggcaaatctggcaacagcagcgcgcggaagatcgcggcgacacctttgaaccgcttatcgacgtccagacgcgctactggtttaacccggcggcgatcagtcagcattttatcattcccggggcggtgaccattatcatgacggtaattggcgccatcctcacctcgctggtcgttgcccgcgaatgggaacgcggcacgatggaggcgctgctctcaaccgaagtgacgcgtgttgaactgctgctgtgtaagcttattccctattattttctcggtatgctggcgatgctgctctgtatgctggtatcggtgtttattctcggcgtgccgtatcgcggttcgctggtaattctgtttatcatcaccagtctgtttttactgagtacgctggggatggggctgttgatttccaccatcactcgcaaccagtttaacgccgcgcaggtggcgctgaacgccgcgtttttgccttcgattatgctgtccggatttatcttccagatagacagtatgcctgcggtgatccgcgcggtgacctatattattccggcgcgctattttgtcagcaccctgcaaagtctgtttctggccggcaatattccggtcgtgttaggcgttaacgtactgtttttaatcgcctcggcggtgatgtttattggcctgacgtggctaaaaaccaaacgacggctggattaaatatgtgtatggataattgtcgtcgtaggccggataaggcgctcacgccgccatccggcattatgcctgatgcgctttgcttatcaggcctacaaactggactgagaggacgggcatgtttcatcgtttatggacgttaattcgcaaagaactgcaatcgcttttacgcgaaccgcaaacgcgcgcgatcctgattctgccggtgctgattcaggtcatcctgtttccgttcgccgcgacgcttgaagtcactaacgcgactatcgccatctataacgaagataacggcaaacattcggtagaacttacccagcgttttgcccgcgcgaaagcgtttacccatgtgctattgctgaacagtccgcaggagatccagccgactatcgatacgcaaaaagcgctgctgctggtgcgcttcccggcggatttctcgcggaatctggataccttccagcctgcgccgatgcaactcattcttgatggacgtaactccaacagcgcgcaaattgccgccaattatctgcaacagatcgtcaaggagtatcagcagacattgatggacggcaagccaaagcccaacaatagcgaactggtggtacgcaactggtataacccgaatctggactacaagtggtttgtggtgccctcgctgatcgccatgatcaccactatcggcgtgatgatcgtcacttcgctgtccgtcgcccgcgagcgtgaacaaggcactctggatcagctgctggtctctccgctcaccacctggcagattttcgtcggcaaagcggtgccggcgctgattgtcgcgaccttccaggccacgatcgtgctggctatcggcatttgggcataccaaattcccttcgccggttcgttagcgctgttttatttcacgatggtgatttacgggctgtcgctggtaggctttggcttgctgatatcagcactttgcgccacgcaacagcaggcgtttatcggcgtctttgtctttatgatgccggcgattttgctctcgggttatgtctcgccggtggaaaatatgccggtctggctgcaaaacctgacgtggataaatcctatccgccactttactgatattactaagcaaatttatcttaaggacgcgagtctggggattgtctggggaagtttgtggccgctactggtgatagcggccaccacgggttcagcggcgtatgcgatgtttagacgcaaagtgatgtagctttttatctttcgccagtagcgagaccacggcgggcccggccaggatagccagccccgccagcgccagtaaaacattgttttgcaatacgcgggatagcagccagaggacaatcagcgcggtgccaaagtaccaggtggtagtcagctcttccagcacatccgccacatcgcgccagcgctgctcatgatggcgctgcaacgccagcatcaatagtaccgtcacgccataaagcacgcataatcccaggccgacgcgcactaatgtgccgctcatccagcctattaccagcatcgccactaccagtaaatgcaacataatctgccaacaaccgaggccggttgcgacacgaacgcgttgttgccacttcatggcttttctcctgaagcatttttctctcattattcagagtaccgaactttacggaaaattccgtaagaccgcatctttttgtgacgacgactacactatttcaatcaggatagtgacgcggacaggaagaaaatgactcaacacacgcgaaatttttcattcaaagtgctcacaattaatacgcacaaaggttttaccgcctttaataaacgcttcatcctgccggagctgcgcgacgccgtcagaacggtcggcgccgatatcgtctgtctgcaagaagtgatgggcgcgcatgaagtgcatccgctgcatatcgaaaactggccggacactacccactatgaatttttggccgacaccatgtggagcgatttcgcctatggccgtaatgcggtctatccggaaggccatcacggtaacgcggttctttctcgctatcccattgaacattatgaaaatcgcggcgtctcggtcggcggtagcgaaaaacgcggcgtgctctattgccgcattacgccgcccatgctcaaccgccctatccacgtcatgtgcgtacatctcggcctgcgggagagccaccgccaggcgcagttaaccatgctggcgggatgggtgaatgccttgccggaatcagaaccggtgctggtggccggagactttaatgactggcggcaaaaggccggcccgccgttaaacgcggccgggctggaggagatattcacccgtgcccatggccgaccggcgcgcacattcccggtgagtatgccgctgctgcgactcgatcgtatttacgtcaagaatgcgaacgccagttctcctggggcgctaccgttgcggaactggcgacatttatcagaccatgccccccttagcgcggagatccatctatgaaatgcggctggcgtgaaggtaatcaaattcagctactggaaaacggcgaccagttctatcctgccgtgtttgaggctatcgctcaggcacagcaaaaaatcattctggaaacctttatcttgtttgaagatgaggtgggtaaaaaactccatgccgctctgctaaaagctgcacagcgcggcgtaaaagccgaagtattactcgacggctacggctctcccgatctcagcgacgcgtttgtcggcgaattaacctcggcgggcgtgatttttcgctattacgacccccgcccgcgtctactggggttgcgaaccaatatcttccgccgaatgcaccgcaaaattgtggtgattgatgatcgtattgcctttgtcggcggcattaactactccgccgaacatatgtcggattacggcccgcaggcgaaacaagactacgcggtacgggtcgaagggcctgttgtggccgatatcctgcaattcgaagtcgagaatctgccggggcaaagccccgcgcgccgctggtggaagcgccatcatcaggctgaagaaaatcgccaccccggcgaagcgcaggcgctgtttgtctggcgggataatgaagaacaccgcgacgatatcgaacgtcattatctgaaaatgctgacccaggcaaagcgtgaagtgattatcgctaacgcctattttttccccggctatcgcttgctccacgcaatgcgtaaagccgcccgccgtggcgtgagcgtaaaactgattgtccagggagaaccagacatgccgatagtcaaagtcggcgcgcggttgctctataactatctggtgaagggcggcgtgcaggtttatgaataccgacgccgtccgctgcatggcaaagtggcgctgatggacgatcactgggccacggtagggtcgagtaatctcgatccgctcagcctgtcgcttaaccttgaagctaacctgatcattcacgatcgtacttttaaccagaccctacgcgataacttacaaggcatcatcgtgaatgattgtaagcaggtcgatgagtctatgctgccgaaacgtacctggtggaacctgaccaaaagcgtgctggcgttccactttttacgccatttcccggcgctggtcggctggctacctgcgcataccccgcatctggcgcaggttcccccgcctgctcagccggaaatggaaacccaggatcgcgttgatccagaaaattcaggagtgaagccctaatggctaaatcgcatccgcgctggcggctggctaaaaaagtgctgacctggctgttttttattgcggtcgtcgttctgctggtggtttatgctaaaaaggtcgactggggtgatgtctggaccgtcatccgcgactataaccgcacggcgcttttaagcgctgtaggactggtgatcgttagctatcttctgtacggctgctacgacctgcttggacggctttattgcggccataagctggcgaagcgacaggtgatgttggtatcgtttgtctgctatgcattcaacctgacgctcagcacctgggtcggcgggatcgggatgcgttaccgactatactctcgcctcggattgcccggcagtactattacgcgcattttctcactcagcattaccactaactggctgggctatattctgcttggcggcatcatttttaccttcggcgttgtccagcttcccgaccactggtatatcgatgaaggcacgctacgtattctcggtatcgttttattgttgattatcgcggtctatctgtggttttgcgcctttgcgaagcggcggcatatgacgattaaagggcagaaactggtgctgccgtcatggaaattcgcgctggcgcagatggcgatctccagcgcgaactggatggcgatgggcgccatcatctggctgctgatgggtcaggatgtgaactatttctttgtactgggcgtactgctggtgagcagtatcgcgggcgtcatcgtgcatattccggcaggcatcggcgtgctggaggccgtattcctcgcgttgctggcgggcgaacatacgtcgcaaggcacgattatcgccgccctgctcgcgtaccgtgtgctttactattttattcccctgttgctggcgctggtgtgctatctgatcctggagagccgggcgaagaagttgcgggcgaaaaacgagcgggcgatggcgaaatgaatttaagcagacgcgttttcgctttccagcacaacgcgttttatccggtaaaaataaacatatgctgagaaaaaagacgtattcatctgtaagcgggaaaaaagcagcaatgaccagctaaacagcagcaggagcacttcgttaaactcacccatgaatactgatgacagggtacagaacgttgccaacgtaacggaaataatggccagcaatagcacataccggtaaataatgaccccgctcatgttcccatgacaatccggtaatgaaatgagaaatcagcgctggcgggcatttcttattaaaatcctcaccgccatttttaatggcgcgagtgacgtctttagcttcacaaaacgctaaccaaaattgtttgccacataatttactcattatacccatcatcaccaacctgaataaaaaacctgcaacacctacggcctgaaagataatagtatttccagaatcatcaaaatgatataacgacacagcgtaaccacagcattaataatgccaaggtaaagcgtcagcgcgccaaataaagcgcaacgaggcagggatgaaaactcgctgtggtataacatgcgggcataaccatgaagtgtcgatttttctagtgctgtaatcaatgtccataccaataccgtcagcacactgactatccagaccagagtgctactggccaccaggctattgacaactatcgcagcgatgatcccgcttaccgccataaaaattaacggcctgaatagaccagaactgatattcaggtagaaaataaataaggcattaagactaaacatgattccaacaatcacgaaaatggtcgcgccacctgagaaaaggtaagctaatgacacgccggtaagcgtaatgatggcaatatatatcaacgttgcgacaacagtgccaaagcgggaaagacaggtaacggccccataccccaggccaagcaaaagtgctgatatccacaaaacaacaacaggttgaacgtgagttatcaaaaaatgactatacaacgttaaccatataataccggcggtacaccatagtcccagcgcagtataccaataggtaagggataacattgtcgcgggaataaatgctatttgccgtatacgtattgcagccagaggtcccacttgtcatttatcactcttcttattatcaccgtaataagaatggcaagcgcaggaaaatatttctaagatgtttatgctgttttgccctaaatatagtcctaaaaaaaatcctggcgcagggccaggattttaagagatcaatatgattagcggcgattgccaaaaatacgcagtaacatcaggaacaagttgataaagtccaggtacagcgttaacgcgccgagaatcgaatacttacgcagattagcgctatcgcgggtatctatttgctcgccgatatttttcagtttctgcgtgtcataggcggtcagaccgacaaacaccaccaccccgatataggttaccgcccacatcagcgcttcactcttcagccagaaattgaccagcgaggccagaacgataccaataagcgccataaacagcatattgccgaaaccgctaagatcgcgtttagtggtgtacccatacaggctcatggcgccaaacattccccccgtcaccacaaacgtgctggcgatggaggaataggtgtaaacgataaaaatactggataacgtcaaatccggttagcgccgaatagagcataaacagcgtcgtcgccattccggcgctaagtttatgcaccagtcccgacagaacaaacaccagcgcaagctgagcaatgattaagccaaagaaggtgatcttactggaaaagacaaacatcatgacggctggcgtattagccgcataccacgcgataaacgcggtcagtaacagtccgaccgtcatccagccatacacttgcgccatataggtctgcaggccagaccgcgcctgcactattgaatcagatcgtggaaatctgtccatgatgaactcctgtgtggaaatgataccctaaagcgtatcacattctgctaccaacgtttcgccaactgctggtcgctgtcgcgcgcttcgacccagcgatcgccttccggcgtggcttcacgcttccagaacggcgcacgggttttcagataatccataatgaactgaccggcgtcgaacgcgctactgcggtgcgcgctggtgacgccgacaaacacaatctcatcgcccggccataattcgccaacgcgatgaatcaccgtgacccgccccagcggccagcgggaacgcgccttcgcgacgatctccgccagagctttctcagtcatgccgggataatgctccagcgtcagcgccttaacgctatcgcccaggttatgattgcgcacttttccggtaaaggtgacgaccgcgccgtcttcgtcgcgcgccgccagccaggaatattcctccccgacgctaaacggcgcagggccgactacaattcgcgtttcgtgcatgttagccccccgtgactggcgggaaaaacgccacttcatcgcccgccgtcagcggatggtcaaaacttaccagcgtctggttgaccgccgccaacagcttgccgtcttccagcgccagcgcccaacgatcgctctttgtcgccagatgctgtcgcagcgactcaacggtggaaaaatctgctggaagatccagcgcatcagttcctgtaagctcgcgaacgtgggcgaagaaaagcactttaatcatgcgcatccaccttaaaatcccccgatttgccgccgcttttcgccagcagacgcaccggaccaattactatatctttttgtaccgctttgcacatgtcgtagatggttaacgccgcgacggacgccgcggttaatgcttccatttcgacgccggttttaccggtcagacggcacagagactcaatacgtacacggttatgctccggctcggcctgaagctgaatctccactttacttagcagtagcgggtggcacagcgggatcagctcccaggtgcgtttagcggcctgaataccggcaatacgggcagtcgcgaaaacatcgcccttgtggtgtttgccatcaacaatcatcgccagcgtttcactacgcatggtaacgaatgcttccgcccgtgcttcacgaacggtttccgctttcgcggaaacgtccaccatgtgcgcttcgcctgcggcgtttatatgggttaattgcgacatcgttatttctttaaatgagggtgaaaattacatgggcgtgtacgggcatccagctgcggcgcaatgatattctcccatgcggttctgcacgcttttgtggagcccggcatggcgaaaatcaaggtgttattcgccacgccagctaccgcgcgcgactgcagagttgcggtgccgatctcttcaaacgagagcatgcgaaacacttcgccaaatccttccacttcacgatcgaacagcggcaacagcgcttccggcgcctgatcgccttcggtcaaaccggtcccgccagttatcaatacgacctgcacctcatcactggcgatccaggcggaaacctgggcgcgaatcgcgtaacggttctctttaacgatggctttcgccaccacttcatgcccggcctcctgcgccgaatcacgcagataatgaccggaggtgtcgtcttcttcgccgcgtcggctggaaacagtaagaatagcgatgcgggtcgggataaattcagcgctgacctgactcatctgaaatctccttattaaggattaaccgccaatgtaagataaattttgcgtaataccagtattgctctggtgaaggaaatgggtctgctttttctcccgcaacgcgtcggaaatacgttcctcaagcgcgtattgctgcgcatcatcctgtaacaggtcgcgtaaactcacgccgccgtcgccaaacagacataaatgcagcttaccgacggacgaaacacgcaggcggttacaggtggcgcagaaatctttttcgtacggcataatgagaccgatctcaccggcgtaatcggggtgacaaaaaacctgcgccggaccatcgctacgctggcggagctggtggatccaaccgcgcttaatcagctcgtcacgtaatacctgacccgaaatatgatgtttgcggaagagatcgctcccctcgcccgtctccataagttcaatgaagcgtagctgaatggggcgaggctgaatccaggcaaggaaggtatccaactgatggtgattcacgtcgcgcatcagcacggtgttgactttcaccttttcgaaaccggcgtcaaaggcggcatcgatgcccgccatcacctggcggaatttgtcctgaccggtaatcgcatggaactgacgcgcatccagactatccacgctaacattgacgcccgtcagccccgcttcgcgccagttcgcggcatcgcgcgccagtcgataaccgttagtggtcaccgcgatctggcgaatagcatcattttcacccacggcggcaatgatgtcggtaaaatcgcggcgtaatgaaggctcgccgccggtaagacgcaccttttccgtgccaagactggcaaaagcgcgcgtaacgcgacgaatttcatcgacggtaaggaaaccgttgttagtgacgccgccaggtttgtagccatccggcagacagtaggtgcaacgaaagttacacacatcggtaatcgacaaacgcaagtagtaaaacttacgcgcgaaagcatcggtaagttgtgaagccatgtacacctttccaaatacgggaggcggagtcatttcttcctgcgccctggtggcaaacgttaaacgttgtcacggccaaagcaccatatcaaaaatgacccaggtgcagaggctagagtgtttattgtggttacgccgatactagcgtgtaaatgacaatttcgccatcacgctttcgctatataaacatatacatagcgatatgatcgtgctatttagcgacagaatacgtgaaaatcacacttttacattgatatatatcatttagccgtggtaacgccctcgctataaaggggtagtcgggaataattaattgtcttttagccggtcggctaattgctgaaaacccgcgacttgcgctactgtagcgctgcttatttgacttcaggaatttttatgcgcaatcgtacgctggctgaccttgatcgtgtcgttgccctcggcggagggcatggattaggacgcgtcctctcctcgctttcttcattaggttcgcgcctgaccggcattgtgactaccacagataacggggggtcaactggccgtattcgccgctcggaaggcgggatcgcctggggcgatatgcgcaactgtctgaatcagttaattaccgaacccagcgtcgcatccgctatgtttgagtaccgttttggcggtaatggcgaactttctggtcataacctcggaaatttgatgttaaaggcgttagatcacctgagcgtgcggcctctggaagcgattaatttaattcgtaatctgcttaaagtggacgcgcagctgatcccgatgtcggagctaccggtagatctgatggcgattgacgatcaggggcatgagatttatggcgaggtgaatatcgatcagttagcgacgccgccgcaggagatcatgttaacgccaaacgttccggcgacgcgggaagcggtacaggccattaatgacgcggatctgattctgattggccctggcagtttttataccagcctgatgccttgcctgctgctggatgaactggcgcaggcgctgcggcgcaccccagcgccaatggtgtatatcggcaatctgggtcgcgaactgagtctgcccgccgccagtttaacgctggtcgataagctggcgatgatggagcaatatattggcaaaaaagtcattgacacagtagtggttgggccgcgagttgacgtcagtgcggtgaacgatcggctggtgattcaggaagtgctggaggccagcgatatcccctatcgccacgatcgtcagttattacacaatgcgctggaaaaagcgctacaggcgttgggttaagcccgtttaccgacgacgctgcgcttatcagaagcctgtttacaccgaagggtaaacaggctctctccctcttctgataaactgcgttcagctatcaccagtaggcgctcatgagcgagctcacctcttttttcagcaatatattctccatgatctcagtaaagagggtctgattgatctcttccattatccgcattccagccatgcgctctgcgtcaggatcacctgctattcctaacgcttccagttcagcattgacccggctctgatactcatccgtttcaatacactcagcccttttggccatcatttcacgccactcttctggcgctatacgctccagcactttatgccacggcccccacagcgcaaaccatttgtgaaaatccctattttcagcaatttttatccttatttccgcctcgtccaggtcagactcagtgatacccgaaacgttataaaatcgcatatcctgggtcattgttgtcagcgacagcgactctcgtaactgattctgaaaacccagatatacttcgatttcgtcaataaaaaacagccgttttaccttttctctggcgagcgattctatttgctccagccgaaagatttcacgccccgccataatcagttccgctaagtggctatcaaaggcgcctctttcagcatcatgaaccaacgtcgcttcctgcatttgatggtatgccagtgtgacccgatcttcacagcttatcgttgcatccatcgctataataaatgcggtttctcttagtgcgctatcatcagccaggcgcattagccaggcggagacttgttccttaaaatccgaatgtcgggtgttctgcgtatcgctaagacgatccagaaacatgctgaaggctgccgcgtttacttccgtctcaaacgcccgccattggttgacgtcttcctcctcgagattggttagccacccctggacagcttgatgcagtggtcgagttacccgaacaattgaaaagtcgcccatggcaaaaaatacctggggtccctgataacccgcagaggacattagccgctgcatattctgtattgttcgttctgaaaaaggattatgttctacgattattcttgtaggttgaggtccttcaccacgaaaacggggtaacgactctgggagacggaccaggcgattgcgagaggcctgcattatttgtaatgccgccgggaggttttccggtagattactcaatgcgttacgggaaacgtccagcgttgttatcgtgggaggtagtgtttcaggcagaacagtaatctgatttttacttacatccaggaactgtaattctggtggtaacgatgcgggcagactggttaaagcattttcgccggcctccagattcttcaggcccggcggcaatgtttcaggcagagcggttaacgaattactctgcacattcaaatgggtaatccctgacggaagatgttctggcagtgtccttatgcggttatcataaacgctcaggtaccgaagttcctcaggtagattttcaggtaaggaactaattttattatgaaaaagatccagcgattgaagcgctgaaggcaaacgttccggcaattcagtaatacggttaatgctcagctccattttctgtatggtatccggtaacgtggcagggatactggttagctgattactgctggcatacagggtctttatatttccctgtaaattttccggcaaacttttcagttcattgttatcgagtatcagagtagttatctgctcaggaatacaggcgggtatagtggtaagtcctaatattttcagacggagttccgtcttattatttttcaggcagtcacgcatccgttgtacggcttcttcacgatttgctgcctcttccgctggcgccgcttttacctactcagaccagattaactcataattcacagtatctttggagccggaagcgctactcgcctgcttgctttctgtcacacgggtataggtgactgacttcccccctccctcaacggtatagccttctgtattaaaaactatagacagaatttcctgactattttcactcaaaatacagtattggtctgcccctcctctactatactgaatattatccgcatacgccgggaaagctaacatccttaaacattcaaacttgcttttgatctcttctggcgaggcggtttcaggtggatgacaaagataagcgattcagctttgtgcttcaacctgatgttctgaagagaaaaaggcacttattttattccatatctcttcttttaaaggcacctctgttgatgcctcattgctaatactttgatgccttgccgtagattgtatattagtaatattaaacatattttccctacctgatctgaacgtaacctaaagtaacagataaggatattctcaactttaaacaagaggccatagtcgtcattatttcggacaaatcattcagtatttgcagcgcttgacttataaatgctcgcgcttccatcacctcttttttaagtagaatgatgtaatctgttgccatgacacgctttcaacgaactcacataagattaaaatgacgatcatgaggatagctataccgataatacggggcgttttttttcatagccgaggagagagggaaaattagcgttgggttcagcctcaacgctaattttcttcagttgtgattaaactagctaccccattgatgttttgactttttcgacaatctcgttagtcaaagcctgtcactgtttttcattcctgactgacttagccctgactattgcactgaaattctcaaaagcgagccatggtaacgatgactcgctggcgatcgacacattgtcaggacgccgcgataaacaactcgcgtaactggtgcaactggtcgcgaatttgcgcggcttcttcaaactccagattttgcgcgtgctgcatcatttgctcttccagttcatgaattttctgctgcaacgctttcggcgtcatatccagttcgacaattccggcttttgccgtagaacggcccttgcctttccccttcgctttggttttcgcaatgttctgccccagcgccaggatgtcgaccacttttttgttcagcccctgcggagtgataccgtgctcttcgttgtacttctgctgcttctcgcgacgtcgctcggtttcgccaatcgccttcgccatcgacggcgtgattttatcgccatacagaatcgctttaccgttaacgttacgcgccgcgcgccctatggtctgaatcagggagcgctcggagcgcaggaagccctctttgtcggcgtccagaatcgccaccagcgagacttccggcatatccagcccttcgcgcagcaggttaatccccaccagaacgtcaaactcgcccagacgcaaatcgcggatgatttccatgcgctccacggtatcaatatctgagtgcaggtaacgcacgcgctcgccgtgctcttccagatattcggtcaaatcttccgccatccgtttggtgagcgtagtgacaaggacacgctcattaatggccgcacgctgacgaatttcggacagcagatcgtccacctgggtcgccaccggacgcacttcaataatcgggtccagcagcccggtcggtcgcacgacctgatccaccacctcatcaccagatttttccagctcatagttgccgggcgtggcggaaacatagatagtttgcggcgctaaggcttcaaactcctcaaacttcagcggacggttatccagcgccgaaggcagacggaagccatactcgaccagcgtctctttgcgcgcccggtcgccgcggtacatgccgcctatctgcgggatggtgacatgagactcatccaccaccagcagtccgtcggcgggcagataatcgaacaaggttggcggcggttcgcccggcccgcggcccgacagaaagcgggaatagttttcaatgcctgagcagtagcccagctcgttcatcatctctaaatcgaactgcgtgcgctggcttaatcgctgctcttcaagcagcttattatttgccagcaagaccttacgcctgtccgccagctcatcttttatctcttccatcgcctgcagaatacgctcgcgcggcgtcacgtagtgcgttttgggatagatagtataacgtggcaccgttgactctacctgcccggttaacgggtcgaacagcgacaggcgttccacttcttcatcaaacagctcaacgcgtagcgcaatgtcgtcagattcagccgggaagatgtcgatcacttcgccgcgcacgcgaaaggtaccacgctgaaaagcttgatcgttacgggtgtattgcaattccgccagccgacgcaaaatcgcgcgctggtcaatcagcattcccaccgtcagatgcagcatcattttcaggtagagatccggatcgcccagaccgtaaatcgcggacacggaagccaccaccacgacatcgcgtcgctcaagcaacgctttcgttgccgacaaccgcatttgctcaatatgttcgtttaccgaagcgtctttttcgataaacgtatccgaacttggcacatacgcttccggctgatagtagtcatagtaggagacgaaatactccaccgcgttttccgggaaaaactctttcatttcgccgtagagctgcgccgccagggttttattgggcgcaagcaccatcgttggccgctgcaagtccgcaatgacgttggcgatggtgaatgtcttcccggagccggtcacgcccaataacgtctgatgcgccagcccgtcctccagcccctcttccagacgacgtatagcgtccggctgatcgccagaaggtttaaaagcggaattcagtttgaacggtttactcatgagcggctacctgaaggagtgagcgggcagggatgtaattttactctcgacggtgaatattgccaataaaaaatactggatgaaaaaacagtaacactccagtgtataatggctatcggcagataccccacgctatttagaggtaaaacatagacagtcgcggggtaaaattccagcagtgtgctggttatccccagaccagagtcttttttaacatttgtcaagtcggatgatgaaagttttatgtcaacgtatcccccttcctttacaaccattgattttatataacttgctgtctaaaaagggatattttctcaagccgtctttcgcgccaatttagtcgcaggccgcgtcgcctctcgcttacgttgtgttttctaactctaatacacaaggttatccacaggaatagtggataactgcttccagcccgtatcccctgccgcctggcaaaatcagcccctgacgttttcgccgggcgataaaaaaaaattatcgctatttttggcagattattggctaacgagaaggcaaaaattgaggcgtagacgctcacattttgcacatttttagcatggcgacgtcaggagggtctggcgaaagaacagcaggatcgtctgatcctgcaagaaggcggtttttaagcgcggtcaggcgcgttccaaggggctaaggtccagatactgtcctgtcgccgcctgcgatggagaaacgcccagccacgggatttcccctaacagcggggccggtatgacgcggcgaagcgtcgcgagatattcaccatgacgcgcgcctggcggctgcatgtcgttggctatccatccgacaagcggtaatccggcctgttctaccgccagcgccgtcagcatggcgtgattaatacagcccagcttgacgccaacaaccagaatcaccggcagctgctccgtctgtacccagtcggcaaacgtcagcgtggcagagagcggtgtaaaccagccgcccgccccttctgtcaacacccagtctgcctgcgcctccagcgttcgtaatccgcgtgataacaccgccgcgtctatcgcccggccttcgtcggcgctagcgatgtggggagaagtaggctcggcaaaagtataaggattgatagcggaataaggttgcggcaggctgctgttacgctgcaaggccagggcatcgctattgcgtagcccgtcggttgtcatttcgctgccggaagcgacgggcttatagcctacggtttgataacctaactgcgttgcggcctgcaataaggcgcaactggcgaccgttttaccgacttcagtatcagtaccggtcacaaaatagcgtttagtcacgttcaatcactcccataaaaaggtggtacgtcagcagatatttcccctgccgctgcggccatgccagttgaatctgtctaagccgggcgcgggttaatacatccgtctcccgcccttcatgaagatgggtggcgccaatgcctttgagcgaacgcatcgcgctcagggcatcctcaaaccacaatgtcatcgcctgagtatgacgagacgcccgccagccgcgtagcgcgtggtcaatggcctcttccggcaaaaagctattcgcgtgagcgcgattatcgacggcctgccatgcctgacgcagctccggcaacgacccctggcacaaggtggtaaacgccaccacgccgccgggccgtacaacccgatacaactcgctcaacgcatcgcgtaaatcgccgcaccactggaccgccaggttgctccaggccaggtcaaaaacttcggcgtcatggggaatcgcttcgatatccgccagcaaatagtgatgcgccgcctgacgatcgcgagcctgttgcagcatcggcagcgaaagatccagggcggtcacttcgctcccccgctctcgccagtaacgactcatacgtccggggccgcagcctgcgtccaacacactggcaaactggcggcctgtcaacagcgtcagcagcgcatccgcgctgtgttgctgtaaagaggcgtgctgttcgtattgcgatgcggcccggccaaacgccgccgcaatagcctgcttattcacctgcgccatgcagcacctccagcagacggtctatatcgcacgcttcatgcgcctgcgttaacgttaagcgcaggcgcgccgtaccgacaggcaccgtcggcggacgaatcgccgtcgcccagcatccttgttgacgcagcgcctccgccaggcgcaatgcacggctgttatcgcccacgattaacggctggatggcgctatgggcattcagtagcgtaaatcgggacgcgttaacgccggcccgaaagcgctgaaccagagcggcgagtttttcgcgccgttcacgaccttcatcgctacggatcaccgccagcgaggcgcttaacgcctgcgcctgggcgggcggcatactggtgctgtaaaccagatgacgggcgaattgcagcagataatctgcgacgctttccgagcagagcaccgctgcgccgctgacgccaaaccccttaccgaaagtcaccaccagcaactcaggcttcaccccccgctgccagcaggtgccccgcccctcatcgccagtcacgccgatgccgtgcgcatcatcaaccaacagccaggcatgatgcctgcgggcaatgtgctggatttccgccagcggcgcgctgtcgccgtccatgctgtatacaccttctgtcaccaccagttgctgacccacgcagggcgattgcagtaaacgcgacagatgctgcgtatcgttatggataaagcggcgaagctgcgccggactcagattagcggcttccagcagggaagcatgactcaacctgtcggccacaatccggtcattttttttcattaaggcggtaatgaccgcctgattcgccgcaaagccagagataaacagcagcgcgcgtggatatcctaaccattgcgccagttcctcctctaacgcctggtgcgccacggaataaccgctgatatgacccgacccgccgctgccgacgccaaaacgcgtcgctgcctgttgccaggcgcgaataatctgcggatgttgacttaagccgaggtaatcattgctggaaaagttaagatactgtcgcccgttcgctaccagccagcgtccggcgccctgcgataccacatagcggcggcgcaacgtatccgtcgcccgacgcgccgtcagcgcatcgtcgacgcgttgttgccaactcataaggctgccgcgttgtaataatcatcggtgtcaggcgtcatcagcgtctgctccagacgttgctgctgctcgttatcgcccgccagcaccctggtctgctgcggattcagccccagcttacggaataactgcagatccttgtcctctgccggatttggcgtagttaacaatttgcagccatagaaaatcgagttcgccccggccataaagcacatcgcctgggtctgctcgttcatctgttcacgtcctgcggaaagacgcacgtatgaggtcggcatcatgatgcgcgctacggcgatagtacgaataaaatcaaacgcatccacgtcatcgttatccgcaagcggcgtgccttttaccttcaccagcatgttgattggcacgctttccggcggcgtaggcaggttcgccaactgcaacaacagtccggcgcgatcggtaaccgtttcgcccagacccacaatgccgccggagcacactttaatccctgcttcacggactttttccagcgtgtcgaggcgctcctgataggtacgggtagtgatgatattgccgtaaaactccggcgaggtatcgaggttgtggttgtagtaatccagcccggcgttagccagacgctgcgcctggctctcgttcaacatgccgagcgtcatacaggtttccagccccatcgctttgacgccctgtacaatcttctccagataaggcatatcgcgttcatgcggattcttccaggccgcccccatacagaagcgggtcgaaccggcgtttttcgctttacgggcggagtccagtacctgctctacctccattaaacgctcggcttccagcccggttttatagcgcgagctctgcgggcagtatttacaatcctccgggcaggcgccggttttgatcgacaacagcgtactaacctgtacctgctgcggatcgaaatgctggcgatgaatttgctgcgcttcaaacagcaattccagcagtggtttttcaaataattcggttacttgcgacagtgtccagcgtgggtggcgagccatcgggcctctccaaaatatgttgtttgtttttgatatggtgtagactcgtaaacctaaatctttttaatttggtttacaagtcgattatgacaacggacgatctggccttcgataaacgccatatttggcatccttacacttccatgacctcgccgctgccggtatatcccgttgagcgggccgaaggctgcgagctggttctcgcctcgggcgaacgcctgattgaggggatgtcctcctggtgggcggccattcatggttataaccacccgcaattgaacgcggcgatgaaagcgcaaattgacgccatgtcgcatgtcatgttcggcggcataacccatcaacctgcggtgaatctgtgccgtaagctggtcgcgataacgcctgagccgctggagtgtgtctttctggccgactctggttcggtgtcggtagaagtggccatgaagatggcgctgcaatactggcaggctcgtggcgaatcgcgtcagcgttttctgacgtttcgccacggttatcatggcgacacgttcggcgcgatgtcggtgtgcgatccggataactccatgcacagcttgtggaaaggctatctgcctgaaaatctgttcgcgccggcgccgcaaagccggatggatggcgaatgggatgaaagcgacatcgcgccatttgcccgcctgatggccgcgcatcgccatgaaatagccgccgtgattctggaacctatcgttcagggcgcgggcgggatgcgcatatatcatccacaatggctcaggcgtattcgtaacatgtgcgatcgcgaaggcattctgctgattgccgatgaaatagccaccgggtttggccgtaccggcaaactgttcgcctgtgagcacgccgggatcgcgccggatattctgtgtctcggcaaagccttaaccggcggtaccatgaccctctcggcaacgctcacgacacgccaggttgcagagactattagcaacggcgaggcggggtgttttatgcatggcccgacgtttatggggaatccgctggcctgcgccgtcgcttgcgccagcctgacgctgctggaaagcggcgaatggcgtcagcaggtggcgtctatcgagtctcagttacgcgctgagttagcccccgcgcaaagttcgccctgggtggcggatgtgcgggtgttgggcgcgattggggtggttgaaactacgcatccggtcaatatggcggcgcttcaacgcttcttcgtcgggcaaggcgtctggatcaggccgttcggcaagctaatctacctgatgccgccctacattattcgtccggatcaactgcgccgtttgacccaggcggtcaatgacgcggtacacaatgaaacattttttagccattaatcagcggtaagcgatgctgcttctggctacacttctggtgagtcaaaaggagagcgcatgaaacttatcagcaacgatttgcgcgatggagataaacttcctcatcgccacgtttttaacggtatgggctatgatggcgataatatttcgccgcatctggcctgggacgacgtgccgatgggcaccaaaagttttgtcgtgacctgttacgatcctgacgcgccgaccggctccggctggtggcactgggtggtggtgaacctcccggcggatacgcgcgtactgacccaggggttcggctcaggcctggtggccgtaccagacggcgtcattcagacgcgtaccgatttcggtaaagcgggctacggcggcgcggcgccgcctaaaggggaaacgcaccgctatatctttacggttcacgcgctggacgtcgagcgtcttgacgttgatgaagacgccagcggcgcgatggtcggctttaacgtgcatttccattcgctcgccagcgcctcgataacggcgatgttcagttaaacgctgtgtcggatggcggcataaacgtcttacccttccaacgggttgggtaagccgaatacgtgccgcgccatccggcaacattcacataaagtccggcaccagacgctgtaacgcgccttgcgccagcagcgtcgtcgcacactcaatatcgggcgcgaaaaaacgatcctgcgtatagtgcgccacccgctcgcgcagtgtctgccgcgcctgttccagtaacgggctggaggttaacccttcccgtaaatctatcccctgacaggcagccagccactccacggcaatgacgccgcgggtattcgccgccatttcccagagtcgccgtcccgccgccggggccattgagacatgatcttcctgattcgccgaggtcggcaggctatccacgctgtgcgggtgcgccagcgctttattctcgctggcaagcgccgcggcggtgacctgggcaatcataaaaccggaattaacgccgccatttttcaccaggaacggcggtaactgcgacatatgtttatccatcatcagcgtgatgcgccgctccgatagcgcgccgatttccgctatcgccagcgccagattatccgccgccatggcaaccggttcagcatggaagttaccgccggagatcacctcccccgcctcggcaaagaccagcggattatcggacaccgcattggcctcagccagcagtacctctttcgtctgacgtaactgggtcagacaagcgcccattacctgcggctggcagcggagggaatacgggtcctgaactttatgacagtggtgatgtgattcagcaatggcgctggtatcggtcagcagatgccggaacaaccgcgcgacgtcaatttgcccctgttgtccgcgcgcggcatgaatgcgcgcatcaaaaggacggcacgatcccagtacggcttcggtagtcagcgcgccgcagacgacggcggaggcaaataattcctgtgcctcaaacaaaccgcgcagcgcgaaggccgtcgacgcctgggtgccgttaagcagcgccagcccctctttggccgccagcgcgacaggttccagtccggccttttttagcgccgcctgcgccggaagccattcgccctgccagcgcgcttttccttcgccaagtagcgtcagcgacagatgcgccagaggcgctaagtcgcccgacgcgccaaccgacccttttgccggaatcagcggatacacgccggcattcaccagagcgatgagcgcctctatcacgctcaaccgaatcccggaaaacccgcgcgccaggctattgattttcaataccatgatcagacgcaccatcgcgtcatccagtgggtcgcctacgcccgcggcgtgagacagcaccaacgatcgctgtagattttgcaagtcttcatcagcgatgcgcgtctgcgccagcaggccgaaaccggtgttgatgccgtaggcggtacgcccttcggcaacaatatcattgacgcacgcaacactggcgttaatgccgtcaatggcgctggcgtccagccgaagctgtaccggatgacgccagacatcgtacagttgagagaggcttaactgccccggagtgagtgtcatggtgttcatatcagcctttcccctgcgtcgccgcaaccatcggtaaattcagaccttgctcaacagcgcattccaccgcgagatcatatccggcatcggcatgacgcatgacgcccgtcgccggatcgttgtgtaacacgcggcgaatacgcgcggcggcctcgtcagtgccatcacagacaatcaccataccggcgtgttgcgaaaaacccatccccaccccgccgccatgatggagcgatacccatgtcgccccgctggcggtattcagcaacgcatttaacagcggccagtcggaaaccgcgtcggaaccgtcgcgcatcgcttcggtttcacggttagggctggcgacagaaccggaatccaggtgatcgcggccaatcacaatgggcgcggatacctcgccgcaacgcaccatttcgttgaacgccagccccagtttttgccgccactccaagcctacccagcagatacgcgccggtagcccctgaaaatgaatgcgctcacgcgccatatccagccagtgatgcagatgtttatcctcagccactatctctttgactttggcatcggttttatagatatcctgcggatcgccggacagcgccacccagcgaaacggcccgatgccacgacagaacagcggacgaatataggctggcacaaatcccggaaaatcaaaggcgttttccacccccatctctttcgccatctggcgaatattgttgccatagtcaaaggtcggcacgcccattttactgaacgccagcatcgcccgaacatgcgccgccatggaacgtttcgctgcctgcatcgtcccccggggatcggattgcgcgtttttctgatactcctcccagcaccagccggagggcaaatagccatgtagcggatcgtgggcgctggtctgatcggtcaccaggtccgggcgcacgccgcgattaaccagttccggcaggatatccgccgcgttcgcgcacagggcgacggacacggctttcccctcgcgggtgtagcgcgtaatgcgggccagcgcgtcatccagcgtggcggcctgctcatccacgtagcgagtacgcagacgaaaatcgatacggctttgctggcattcaatcgtcagcgaacacgctccggccagcgtcgcggctagcggttgcgcgccgcccatgccgcccagcccggcggtcagcgcccagcgtcccgccagcgtgccgttatagtgctgacgccccgcctcgacaaaggtttcgtatgttccctgcacgattccctgactaccgatatagatccagcttccggccgtcatttgaccgtacatcgccagccctttcgcatccagttcgttaaagtgttcccatgtcgcccagtggggaaccaggttggagttggcgattaatacccgcggcgcgttgtcgtgcgttttaaatacgccgaccggtttgccagactgaatcagcaacgtttcgtccgcctccagccgggtgagcgcatcaacaatagcgtcatagcattcccagttgcgcgcggcgcgaccaatcccgccgtagaccaccagctcatgcggattttccgccacgtcaggatcgagattattcattaacatccgcagcggggcttctgtcagccagcttttcgccgttaataccgtgcctcggggcgcgcggatagtctgctgacgatacttgctttcaggcatagcaatgactcctcattattatcggtctgccatcgccaaataacgctaaaacgccactatcaggcaccgccgcagacccacagataagaatcagacatatacttatctatacaagtaagcacaagaatagaattaacaaaaatgatacaattttgttatattgtgtcagcaatcacgttttccggcagcagccgctcaggagataaatcgtccctgtagccggtagcgcgacccggggaaaagtaagcgggcgtgagaaacaatccgcgacgcggaccaggttgtacgacgaatgagcagacaaggctcatgctctttgatagttaaccacgcgcactcttgcgccgtggcgcgcaccgcctccacaatatgttccccttccgttagcggcgcgatccgcgacaaataagcgtgcggcgtggtctgacggtaatcctgcgtcaggtaatccacggcaatatccgcattcacgcagcgatcttcaatttgtaccggcagatcgttttcataatgcaccatgatggaatggaaaatgacatcactctcattgacgttgagagcgctggcctggatggcgtttgcccgcacacgctccagcgtgagcacctcacaacgatgctgatgatggcgggcggcaatctcctcggcgatactgcggacttcaaacagtgcggactggcctttcggttcggcgacaaacgtccccacgccctgtaaacgcaccagccacccttcatccgtcagctcacgcagcgcccggttgatggtcattcggctaaagccatactgagcgaccagttcagcttccgacggaatgcgatcgtgcggctgccagacgccgccggctatttttttacagatgtcctgtttcaccgtttcgtaaaaaggcgcaggcgcagaacgggagcgggatgaatacatgcgtgaagccttccttatgcggataatgttttccggatgacagattaacgccaccagtgcgcgatttgccagccaagccgcgccgccacgcgcgccgctgcgcgcgccgctgcgccatcttcatcaaagcgtggattaaattcaaccagatccgccgcctgtaattttccgctgcggcaaaccggctcaattaaacgcagaacctgtatcagcggcacgcccagcgctgcgggagcggagacggccggcatttcccagacaggcaatacgtcgagatcgatagtcagataaattttatccaccttgtcaataaactgcgtcatctgcgccagcgcgtcatggcagtccagatcctccaccacggtaacattccgccactgcgcttcccgccacaacgcctgcgtattcgccgcacggctcacgccgaaacaagcataatgaaacgcgcggctctgcgcgtcgcatagctgcgccagttgacgaaacggcgtcccggatgttgcccggtcggtctgacggagatccagatgcgcatcaagattaatgatccctacgctttcctgcgcaaacgcgtccagcacccccgcgccgtgtccaaacgcggtttcatgcccgccgcccattaccagcgtgcgcatcccggcccgcagacagcggcttaccgcatcgcgcaaggcctgctgcgcgccttccagatcgggcgtcggcgcaacccaattgcctaaatccaccagccgttcatgtccctgatggctggccatattcgccagcgctttacgcaacgcgtccgggccgcctgccgcgccgggacggcctgaattgcgttttaccccctcgtcgcaggcaaatcccattaacgcgatcttttgctgccagttttcggggaaaaaggcctcgctgcgcgtgacggtctgaaacagacgccgcgcatccggcgcttctatactgtcatcgcgcccctgccagagcgccggagaagccggataccattgcgtcatgagatttgtcctctgtatacccgctgatataaagggttacgccccggctcatacacaatctctaccggctgttcagcatcccacaccacaaaatccgcccggtagccggccctgatctgcccatgcgtcgcctgtcttcccagcgcgcgagcggcatggcgcgtaacgcccgaccatgcctcttccggcgtcagaccaaactgtacgcaggccatattcatcgccagatgcaaactgcaaaacgggctggtgccgggattgaaatcgctggcgacggcgacaggcacctgatagcggcgcagcagttcaaccggcgggcgctgcgtctcgcgcagaaaataaaacgcgccgggcaacaacacgccgacagtaccgccgtcacgcatcgccgcgacgcccgcttcatcaagatattcgatatgatccgccgataaaccctgataacgactcaccagctgcgcgccgcccaacagcgaaagctgctcaacatggcctttaacgggaatacctaacgccttcgccgtctgcaacacgcgctcactctgggccacattaaagccgacgctctcgcaaaagaggtctaccgcatcaaataaccctttttgccagagctgcggaatcatcgtctcgcagaccagagtgatgtagccgtccgggtcgtcacgatactccgctggcgtagcatgagcggccaatagcgtggggctaatgtcgatagcgttttcggcagcaagttttgcagcgacgcgcaacagcttttcttctgtcgccagctccagaccatagccggatttaatctccagcagcgtaacgccttcgctggcaaggcgcatcatgcgttcgcgcgccagcaggtagagcgtctcctccgcacaggcgcgggttgctgataccgtcgcgttaatgccgccgccctgagcgctaatatgctggtatgacgcgccgttaagccgctgctcccactctgcggcgcggttaccggcaaacaccagatgcgtgtggcaatcgataagtcccggggttaccagtcgtccctgcatatcatggatattgtccccactgacaggaagctgcgtctctggcacgatatcgcaaatatgcccttcgcgtacaatcagcgcctggctatccaccagcccgtacggggcttgccgctgcgggtccattgtcgccagcctgatgtttcgccagacagtatcgcccggtaaaagttgccgcattcctgtcgctctcttgcctgtcatgagttgtatagacatttattttctttctgctccggattgtcaactcaaagcgcgaaagttgttgcttaattgtgataaaactatctgatgctacaggtgtttccagcctgaaaaggaactttttaccttttcgccttcccgtttcgttcaacttagtataaaaaagcaggcttcaatggatgtcatttaactttttcaagcccggagcaacctgtgaatacattatcggtttcccgtctggcgctggcactggcttttggcgtgacgctgagcgcctgtagctctacgccacccgatcagatcccttccgatcaaaccgcgcctggcaccgcctcgcgccccattctgtcggcaaatgaagcgaaaaacttcgttgctgcgcgctattttgcctccctgacgccgaataccgccccgtggtcgccgtcgccgattaccctgcccgcacagcctgactttgtggtggggccggcaggtacgccaggcgttacgcacacctcgattcaggccgcgatcgatgcggcaatggttaaacgcacgaacaaacgccagtacattgctattatgccgggcgactatcaggggaccgtgtatgttcccgccgcgccgggaagtctgaccctgtacgggaccggtgaaaaaccgatcgatgtaaaaattgggatggcgattgatggtgaaatgagtgtcgctgactggcgccgcgcagtgaatcccggcgggaaatatatgcctggtaaacccgcctggtatatgttcgataactgccaaagcaaacacgccgcgacgatcggtgtaatgtgttctgccgcgttctggtcgcagaataacggtctgcagctacaaaatctgaccatcgagaacacgctgggcgacagtgtcgatgccggaaaccatccggcggtggcgctgcgtaccgatggcgacaaagtccagattaacaaggtcaatatccttggccgccagaacaccttctttgtgaccaacagcggcgtgcagaaccgtctgcaaaccgatcgccagccgcgtacgctggtgacgaacagctatattgaaggcgatgtggatatggtttccggacgcggcgccgtggtgttcgataacaccaacttccaggtcgtcaactcccgcacacagcaggaagcctacgtcttcgccccggcgacgctgtccaatatttactatggctttttggcgatcaacagccgctttaacgcctccggcgatggcgttgcgcagcttggccgctcgctggatgtcgacgccaacaccaacggtcaggtcgtgatccgcgacagcgtgattaacgagggcttcaacgttgccaaaccgtgggccgacgcggtcatctcgaaacgtccgtttgctggaaatacgggaaccgtggatgacaaagacgaggtgcagcgtaatctgaacgacacgaactacaaccgcatgtgggaatacaacaaccgcggtgtaggcagtaaagtagtgacggaacctaagcagtaatcgccgttccggttcaggcttataaacgggccgccgcagcagatgtggcggcccgtggttttactgcaagcgatgtttattgaaattaatcaggcatcctgccctggtgagctccagcccgccgccctccggcacacagcgctttagtacgcgttcaccacaacccacattggcccctggccgacggcataacggcctttttccgtcagcaacccctgagtgcccgtaatttcatagaccgcgatatgatgtgatttttgacccgcagcaatcaggtatttcctgctgttgtcgatattaaagccgcgcggttgggcttccgtcggctggaagccttcaacgctcagtacgctgccatcttcggagacactaaagacggtaatcagactggcggtgcggtcacaggcatacagatgccgtccatccggcgtaatatgaatatccgccgcccagcgggtatcggaaaaatcggcgggcatcatatccagggtttgtacgcactctatctcgccatgcggatttttaagctgccagacatccaccgaactgttcagttcattgacgcaatacgcatattgtcgattcgggtggaagaccatatgacgcgggcctgccccttcaactgtatttacttccgccggctcctgggccaccagatggccgtcatcgcttagcgtaaacagacaaatgcgatcctgttttagcgcaggcacccacagggtacggttatccggcgtaatatttgccgagtggcagccgtccagcccttccaccacatccaccagctcaaccggcaggccatcctgtaagcgcgtcacgctgacattaccggcgttatacgatccgacaaagacaaaacgaccatgatgatcggtagaaatatgggtcgggctacccggcagggcggattcggcggcaaacgtcagcgcgccatcatccggcgcaatacgatacgccaggacacgaaactccgggcgcacgccgacatagaggtagcgtttatccggactgaccaccatcggctgaacctgaccgggcacatccacgacctgcaccagcgtcagcgtcccttcgtggttcaggctccagacgtgaatttgctgactctcagggctggcggtatagactgtttgtttcatgaatactcctttgcatatggcatgtagctgcaataacaggacacagcttaacgtagtcgcttttgacggcgaatgctgaattcagacgcagaattttgtctgcttaccgtcccggtgtaccatgccgacagacggaattattactcttaatctggaaaaaattatgactgcacgcgtgattgccctcgatttagacggaacattattaaccccgcataaaaccttactcccctcctcgcttgaagcgctatcacgcgccaaagaggcgggctttcaacttatcattgtcactggtcgccatcacgttgctattcatcctttttatcaggcgctggcgctggaaacacctgctatttgctgcaacggcacctatttgtatgattatcaagctaaaactgtcctggatgccgatcctatgcccgtggataaggcgttgcagttgattgatttactggatgagcatcagattcacggcctgatgtatgttgatgacgctatgctttacgaacacccaaccggtcacgtcgtgcgtacctcccggtgggcgcagaccttgccgccggagcaacgtccgacctttacacaggtctcttcgttggcgcaggcggcgcgcgacgtgaatgccgtgtggaagtttgcgcttaccgatgaagatattcccagactacagcggttcggtcagcatgttgaacaggcgcttggcctggagtgtgaatggtcatggcacgatcaggtggatatcgcgcgcaaaggcaacagtaaaggcaagcgccttacccagtggatagaagcgcagggagggtcaatgaaaaatgtgatcgctttcggcgataactacaacgacatcagtatgctggaggcggcaggcaccggcgttgcgatgggcaacgccgatgaggcggtgaaagcgcgcgctgactttgtgatcggcgataacactaccgatagcatcgccaaatttatatacacccacctgctatagtcaggcggtgatagaaacgcttttcacctgcgcgtaaagccacaggccaggcttgatattcagctcatccctggcccacgggcttattcgcgcccacagcgttctgccgcctatttcaagctggacttccacctgcccgttatcgtcataacaattcgccacttttgcccgtaatacgttgcggatactggtctgctgcggcggctgtagtaccagcgagacatccgacgcctgtatacgaatacgcagtgtggattgcagcggctgattgagtttatttacccacaggtgctggtcgccaagcgccagagcggtcatggcataatgcgggtgatgctccagcacgctgactttcagaatactgctctgttgctctttcggcagccacgggtgcataacgctgcttccccagacttcttccagcgggccaaacgctttaacctgtccatcctccagcaccatgactttatccgccaggtggagaatttcatcgagagaatggctgacatacagcatgggaatattgatttctcgcgccagccgttgcaggtacggcagtaattcgcgtttacgcgggatatccagcgaggccaacggttcgtccaacagcagcaactccggggcggtgagcaatgcccggcctatcgctacgcgctgtttttctccgccggacaggctccccggcaggcgatcaagcaacgcttcaattcccagcagcgacaccagcttatcaaactgaccggtcatgcttttcgccatgccatagcgcaaattgccgcgtactttgtaatgggggaacaggcgcgcatcctggaaaacataaccgatgcggcgcttttccggcgttaaacagataccgttttccgcgtcatgcaacacccggccattcagcacgatgcgtccttttcgcgggcgagtcaaaccgctgatggcattaatcagcgaggtttttcccgcgccggagacgccaaagatagccgtgatcccactggctggcagcgtttcgttgagggttaaacagtgcgttcccagcgtctgggaaaaattaagctccagcatggttagcgccccgtccgttcacggctaatccgcgccagccattcagaaatcaacagcgaaatcagcgctaatacaatcgaaatcacgcacagcctcgccgccgcgctctccccgcccggcgtctggatcaaggtatacatggcggaaggtatggtgcgggtttcgcccggaatattggaaacaaaggtaatggtcgcgccaaattcgccaagcgaacgggcaaacgccagcaccgtaccaacaataatacccggcagggtaagcggtaaggtgatagtcagaaaaacgcgccagcgcccggcgcccagcgttctggcggcctgttcaagcttgatatccaccccctccagcgccagccgaatggcccgcaccatcagcgggaaggacatcaccgccgccgccagcacggcgccgcgccagctaaaggcaaacgtgagaccgaaccagtcatacagccactggccaataaacccgcgtcgccccatcgacaccagcagcagatagccgaccaccaccggcggcagcaccagcggcagatgcaggacactatcaagtaaggctttgcccggaaaccggcatcgcaccagtaaccaggcaaaaaagatcccaaacggcaggctaaacagcacggccagggaagacactttcaggctaagaaggacagcctgccattctggatcggtcagtatcattacttcgtcgtaaatccataacgtttaaagattgccgaggcctgcggtcctttcaggtaatcatagaacgcgctgacggccgcatttttatgcccctccacgatagcgatggggtattccacttttttatgtgaatcttccgggaacgtcgccaccacgttgacccccttgctggcgaccgcatcagaaccgtatacaatgcctaaaggcgcttcgttacgttcgaccaacgccaacgcaccgcgcacatcctcgcccggcgccagtttcggttcaagcgtttgccatgcgcccagcttttgcagcgcttctttggcataaattcccgccggtacgtgttgcggatcgcccaccgccagacgcccgccgttcagcagatgaatccagtccgttttgttgtcgatggtaaacggtttctgctcgctggctttcggcgctaccactaccaggctattgccaagcaatgtttcgcgcgtcgtggtatccaccgcttttttatcggctgcgtaatccatccatttctgatcagcagagatgaacaggtccgccggcgcgcccgcttctatctggcgcgccagcgttgaagaggaggcgaatgaggagaccacatccacatttttctcttttttatattctgccgcaatgtcttgcatcgcgttcgttagcgacgcggcggcgaatacggtgatcttgccttcatccgccagcgcatgaccagcgatgacgaaagataatgtcgcccctgcgaccaggcgtaaccaggaatgcgccatctgtaactccttgtgcgtttcgttatgtaaacaacaatataacgataatctcaggggtttcccagcggttattcatacccattaacgattaaacacagaaaatatcggcaggaaaagcaggatcttgagtaacaaaaacgcccgactgagcgggcgtttggggaaatcagcggttctgtctggactggtctttctgaccgataccggaaaaaatgttgaacacctcacccagaccgtaaatcagaccgaggatgatggccatcactaccggtaccatgatgacggcgaataccagactttttaataactctaacatgggcaactccagatatagtcctttttgtattttaaccgcatcacacagaaaagcactccccttttgtgcggtcggctttgcgctgacgcgcttttcagtcacaatagtctttttactaggagctggttatgcaggccgaaatccttcttaccctgaaacttcagcaaaagctttttgccgatccccgacgtatctctctgctgaaacacattgcgctttccggctcgattagtcagggcgcgaaagacgcgggaatcagctataagagcgcctgggatgcgataaacgacatgaaccagcttagcgaacatatgctggttgaacgcgcaacgggcggcaaaggcggcggcggcgcggtattaacccgctatggtcagcgtctgatccagctttacgatttgctgggccaaattcagcaaaaagcgttcgatgtgttaagcgacgatgacgccctgccgcttgacagtctgctggccgctatctcccgcttttcactgcaaaccagcgcccgaaatcagtggttcggcaccattaccgcccgcgatcgcgatcaggtgcaacagcatgtcgacgtgctgctggccgacggcaaaacgcggctcaaagtcgcgctgacggcgcaaagcggcgagcgtctcggcctggaggagggaaaagaagtgctgatcctgctaaaagcgccgtgggttggcattacccgggatgcagccgttgcgcgcgcagctgacaatcagttgtcgggaacgatcagccatatcgagcgcggcgcggaacagtgtgaagtgttgatggcgctgccggacggccagacgctgtgcgccacgataccgactgcggatgccgccacgttaaaggaaggcgatgacgtgattgcctggtttaatgcggacagagtgattattgcaacgttgtgctaagcacattgacatccgttgccgaaagacgtatccctgtcattcatcgctgcaaaaaatgggatgcaaaatgtcatcgttgcaaatttcgcaaggcacgtttcgtctgagcgatacaaaaacacttcatctggattcgctgacgctcaatgcgggcgatagctgggcattcgttggggctaacgggagcgggaagtcggcgctcgcccgcgcgctggcgggtgaactgccattattaacaggcgagcgccagtgtcagtttacccgcattacccgtctgtcctttgaacaattgcaaaagctggtcagcgatgagtggcaacgtaataacaccgatatgctcagtcctggcgaagacgataccgggcgcactaccgcggaaattattcaggatgatgttcaccatcctgcccgctatgcgatgctggcgcagcagtttggcatttccgctttactcaacaggcgttttaaatacctttctaccggcgagacgcgaaaagcgctgctgtgtcaggcgctgatgtctgagccggagttattaatccttgatgaaccgttcgacggacttgacgtgaccgcccgtcaacaactggcacaacgcctgacggcgttgaaccaggcgggtatgaccctggcgctggtactcaaccgttttgatgagatcccggacttcgtgcagtttgccggcgtgcttgccgactgtacgctggcggagaccggaacgacggcagagttactgcaacgggcgttggtcgctcaactcgcgcacagcgagcgtctgaccgacgtacaattacccgaaccggacgaaccttccgcccgccatgcgttacccgatggcgaaccacggatcgtacttaacgatggcgtagtctcgtataacgatcgccctatcctccaccacctaagctggcgagtcaatccgggcgaacactggcagatcgtcggtcctaacggagcgggtaagtctacgttgcttagccttattactggcgatcatccgcaaggctacagcaacgatcttacgctgttcgggcggcggcgaggaagcggcgaaacaatctgggatatcaaaaaacatatcggctacgtcagcagcagtttacatctggattaccgcgtcagtaccacggtacgcaatgtcattctctccggctatttcgattctatcggcatttaccaggccgtttcagacaggcaacgaaaactggcgcaacagtggctggatattctgggaatcgataagcgtacggcggatgcccccttccacagtctctcttggggacagcagcggctggcgctaatcgtgcgcgcgctggttaaacatccgacagtgttgattctggatgagccgctgcaagggttggacccgctgaaccgccaactggtacgccgttttgtggatgtattaattcgccagggagagactcaactgctgttcgtttcccatcatgcagaggatgcgcctgcctgtattacccaccggctggaatttgtaccagagggcgaacgttataagtacgtttccggacgatgcaataattaaatgtattatcagaatggcgccgcgcgccattctggaaccactctccttttattaagaataataataacggtcgataagcttactatctcttgaatcgctgaccgcctcattgtcataataatcctgaaattttcgacaatgatgtcgtatgtgaatacaagggattcattatggcttttcgttttccacaaataatactatttttactggcagccatgttattttgccccagcagttatgctgagcaaaagccgaccgctgcgcaggaagcgcgtaaaaccgccgttgaggtcgctgttgaaggcatgagtcgcgccgccgttgcgggtccgacaaagattagtttaggtgataaagccacgcttaatctaccggaaggatttacctggatacccgcaaaagaagcggcggtatttatgcgtgaaattggtaactatgttgacgatgaatatttttacggtctcgtatttaaaaaggaaatgaatggatttatttctatcgaatatgatgattctggttatgtaaaagatgatgatgcaaaaaactgggatgccgatgaattaatggataacctgcgcaaaggcacaaaagaagcgaataaagatcgtattgcaaaaggcattgagccgatagaaattattggctggatcgagaagcctacctacgatgcaaccaatcatcgtctgatctggtccgccgccatccaggatatcggcaccaacgaaccactgaatgaacaaggcgtgaactacaacacctatctgctgggacgtgaaggttatttttctttaaatctggtgaccaacagaggttctgttgaccacgaaatccctctggcgaaaagaattctcagttccgtcaagttcaacgctggacaacgctacgctgacttcaacgaatcaacggacaaaatagcggagtatgagctcgccgcgctgattggcggtatcgcggccaagaaagtaggactgcttgctatgctcggtatcgcgttacttaaattctggaaagtgaccgccatcggcgtcgtcgctgtcggggcgctcgccaggaagctactctcgcgtaaaaaagactgacagctcctgccccgtccgtttcattcccaggcgcgtaacgcgcctttttttcggataaaaagcagaagcattctcaagtcagatgatttgtaatcatttaattgatataaatgcgtaaaatcaccagcgtgtaaacgattccactaatttattacatgtcacacttttcgcatctttgttatgctatggttattccataccataggcttaacggagcgaattatgagagtattggttacaggtggtagcggttacattggaagtcatacctgcgtacaattgctgcaaaatggtcatgacgtcgtcatcctcgataacctctgcaacagcaagcgcagcgtgctgcccgttattgaacgtctgggcggtaagcacccgacctttgtcgaaggcgatattcgcaacgaagcgcttataaccgaaattctgcacgatcacgcgattgataccgtgattcactttgccggcctgaaagccgtcggcgaatcggtcgccaagccgctggagtactatgacaacaacgtcaacggtacgctgcggttggtcagcgccatgcgtgcggccaacgttaaaaaccttatttttagcccctctgccaccgtttatggcgatcagcccaaaattccttacgtcgaaagttttcctaccggcacgccgcaaagcccctacggcaaaagtaaattgatggtagaacagatcctcaccgatctgcaaaaagcccagccggagtggagtattgcgctgctgcgttatttcaatccggtcggcgcgcacccgtcgggcgacatgggagaagatccgcaaggtattccgaataacctgatgccctatatcgcccaggtcgccgtgggtcgtcgcgaatcgctcgccgttttcggcaacgattacccgaccgaggatggcaccggcgtacgcgattacattcacgttatggacttagccgacgggcacgtcgtggcgatggaaaaactggcggacaaatccggcgtacatatttataacctcggcgcgggtgtcggcagtagcgtcctggatgtggtcaacgcctttagtaaagcctgcggtaaacccattaattaccacttcgcgccgcgtcgcgacggcgatctcccggcgtattgggcggatgccagcaaagccgatcgcgagctgaactggcgcgtcacccgcacgcttgacgaaatggcgcaggacacttggcactggcagtcacgccatccgcagggatactcagattaaggacgttgttatgaccccatttaatcccatcgatcatccgcatcgccgttataacccgcttaccggccagtgggttctggtttcgccgcatcgcgcaaaacgcccctggcagggggcgcaggaaacgccgtctcagcaaatgctgccggcccacgatccggactgcttcttgtgtgcgggcaatacgcgtgtcaccggcgataaaaatcccgattacaaagggacttacgtctttactaacgatttcgcggcgctgatggccgatacgccggatgcgccggacagccacgatccgctgatgcgctgtcagagcgcgcgcggcaccagccgcgtgatctgcttttctcccgatcacagtaaaacgctgccggagttgagcctgcccgcgctgacggaaatcgtcagaacctggcaaacgcagaccgccgagttaggcaaaacctatccgtgggtgcaggtctttgaaaataaaggcgcggcgatgggctgttcgaacccgcatccgcatggacaggtctgggccaacagcttcctgccgaatgaggccgaacgcgaagatcgtttacaaaaagcctatttcgccgaacagcgtccgccaatgctggtagattatgtccagcgagaactggcggacggcagccgcaccgtggtcgaaaccgaacactggctggcggtggtgccttactgggcggcgtggccgttcgaaacgctactgttacccaaaacgcatgtcctgcgcattaccgatttaagcgacgagcagcgcgactctctggcgctggcgttgaaaaagctgaccagtcgttatgacaacctgtttcagtgttccttcccctactcaatgggctggcacggcgcgccgtttaacggtgaagaaaacgcacactggcagttgcacgcgcacttttatccgccgctgctgcgctctgcgaccgtccgtaaatttatggtcggctatgaaatgctggcggaaacccagcgtgatttaaccgcagaacaagcggctgaacgcctgcgcgcggtcagcgacatccattttcgcgaatccggagtataaaaatgaatctgaaagagaaaacgcgcgcgctgtttgctgaaattttcggctaccctgctacccacacgattcaggcgccaggccgcgccaatctgatcggcgagcacactgattacaatgatggttttgttctgccctgcgctatcgattaccagaccgtaattagctgtgcgccgcgcgacgatcgtaccgtacgggtgattgccgccgattacgacaatcaggtggacgaattttcactggatgcgccgatcgtgacccacgatagccagcagtggtctaactatgtgcgcggcgtagtgaaacacctgcaacagcgtaacaacgcgtttggcggcgtggatatggtcatcagcggcaatgtgccgcagggcgccgggttaagctcctccgcttcgctggaagtggcggtgggcaccgtcttccagcagctttatcacctgccgctggacggcgcgcaaattgcgctcaacggacaagaggccgagaaccagtttgtcggctgtaactgcggcattatggatcagctcatctctgcgctcggcaaaaaagatcatgcgttgctgattgattgccgtacgctcggcgccaaagcggtttctatgccgaaaggcgtcgccgtggtgatcatcaacagtaactttaagcgcactctggtgggcagcgagtataatacccgccgtgaacagtgcgaaaccggcgcccgtttcttccagcagccggccctgcgcgatgtcagccttgaggcgttcaatgccgtcgccagcgaactggacccggtagtcgcaaaacgcgttcgccatgtattgagcgaaaatgcgcgcaccgttgaagcggcaagcgcgctggagaaaggtgatttgcaacgtatgggccaactgatggcggagtcccatgcctcaatgcgcgatgatttcgaaattaccgtcccgcagatagacacgctggtagacattgtcaaagcgaccatcggcgatcaaggcggcgtgcgcatgaccggcggcggctttggcggctgtgttgtcgcgctgatcccggaagatctggttcccgctgtgcagcaggccgttgcgcaacagtacgaagcgaaaaccggaatcaaagaaaccttttatgtatgcaaaccgtcacaaggagcaggacagtgctaaatgaaacgcccgcactggcccccgatggtcaaccgtaccgcctgctaaccctgcgcaacagcgcagggatggtggtaacgctgatggactggggagccactcttctttccgcccgtattccgctgtctgacggcagcgttcgggaagcattgctgggctgcgccagcccggaacactaccctgaacagacgtcattcctcggcgcctctattggccgttacgcgaaccgtatcgccaatagccgctatacgtttgccggcgaaaccgtacagttaagcccaagccagggcgagaaccagctacacggcggaccggaaggctttgacaagcgccgctggcaaattgtgaaccaaaacgatcgccaggtattattcgcgctcacctctgatgacggcgaccagggctttcctggccatctttgcgccacggcgcaatatcgtctgaccgatgacaatagaatctccatcacctaccgggcgacggtcgataaaccctgtccggtgaatttgaccaaccacgtctattttaatctggacggcgatcggaccgacgtgcgccaacataagctgcaaattctggcggatgagtatctgccggtagatgaatccggtattccacgccaggggctaaaatcggtagccaatacctcgtttgacttccggatgccaaaagtcattgccagcgagtttctcgccgatgacgatcagcgcaaggttaaaagctacgatcatgctttcctgctacagacgcagggtgatggcaaaaagccggcggcccgtctgtggtcacaggatggaaagctacaaatgatggtttacaccaccgccccggcgctacagttttattccggcaattatctggcgggtacaccttcccgcggaccggaaccttatgccgactggcaagggctggcgctggaaagcgaactgctgccggacagcccgaatcatcctgaatggccgcagcctgactgtatccttcgccctggcgaggagtacgccagcctgaccgagtatcagtttattccgttctaacgatatgccgctacatgcccgatgacgcaagcttatcgggcctacgcgccattgccctgctcaaacctccaccacttaaagacaaaatcgcaactctgagttcacaagaaccttacactgcgccactattttcgctatggttatgcgtaagcattgccgccaacacctcgcggcaatataatgagaattattatcattacatatgatttataggagtgagagtatggctgtaactaagctggttctggtacgtcacggtgaaagtcaatggaacaaagagaaccgtttcaccggctggtatgatgttgacctgtctgaaaaaggcgtaagcgaagcaaaagcagcgggtaaactgctaaaagaagaaggtttcagctttgattttgcctacacttccgtactgaaacgcgctatccatacgctgtggaacgtactggatgaactggatcaggcgtggctgccggtggaaaaatcctggaaactcaatgaacgtcactatggcgcgttgcaagggctgaataaagcggaaacggcagaaaaatatggtgacgagcaggttaagcagtggcgccgcggttttgccgtgacgccgccggaactgaccaaagatgatgagcgttatccgggtcacgatccacgttatgccaaactgagcgagaaagagctgccgttgaccgaaagtctggcgctgaccatcgaccgcgttattccttactggaacgacaccatcctgccgcgtatgaagagcggtgagcgcgtgatcatcgccgctcacggtaactcattgcgtgcgctggtgaaatacctggataacatgagtgaagatgagattcttgagttaaacatcccgaccggcgtgccgctggtgtatgagttcgacgaaaacttcaagccgatcaaacattactatctgggtaacgctgacgaaatcgccgcgaaagcggctgccgtggcgaatcagggtaaagcgaagtaatcacctttgccggatggcggtataactgccttatccggcctacgagcaatgggtaggccggataagcgcagcgccatcaggcaatatgtcttaaacagcgatcacgccgtccagcaccacctgcaatttcccctgcgaacagcgctccacgcgtcctcgtacccggtacacttcagccagacgctccgcagtaatcaccgtctccggcgcgccgctggcgaccagcctgccgtcttttagcatcaggacatggtcaccatgacgcagggcaatattaatgtcatgcgccacgactatcgtcaccctattttgcgcctgggtatcccgacgcacgagatccattacgtgaaactgatagtttaaatccagcgcgctgagcggctcatccagcaacagaagttcagggcgacgaatcagcgattgcgccagacccactaactgccgctgaccgccggaaagctggtcgagatactgcaacgccagatgcgttatgcccaattgctcaaggatagccagtatctgcgctctgccctgcgcattgtctctgccgcctgatgcccgcagtaccacgataatcgactccagtacatgcagatgtacgccctgcggtaatgactgcggcaaaaacacaactttctgcgcccgctcggcaaacgataacgacatgagatcttcgccatcaagcagcgcctcgccgtcgacgttattcagcccggccagcgaacgtagtaacgtcgatttaccacagccgttcggccccagcaaaatggtaattttcccgcgcggcagtaagggaacgttgagatctgcaataaccggctgagtggaatagccggcgctaaatgagcggagcattaacctgcgcatcagagactcccccgatgtcgcaatacaatgcttaaaaagaacggaaccccgaccagcgaggtgacaatccccaccggcaccatgacgcccggaatactatttttcgccgcaatagaggccagcgataacaccagcccgcctatcagcacgctgcccggaaggtagaaacggtgatcttcccccaacagtattcgcgcaatgtgcggcgcaacgagaccaataaaaccaatcggcccgacgaaagctaccgccagcgctgataacaagctgatacgcaacaatgacagcaggcgtaaacggcggacatgaaccccaaagctcatcgccctctcttcgcccagacgtaatgccgtgagttgccaggcgcttcgtaacgcgcaaaaaagcacagcaataaacaccacggccagtacgcccaatttttcccacgacgcgcggaccaggctccccatcgtccagaataccagcccctgcagcgtatcttcatcagccacaaactgcataatggcgaccaacgcgttaaaggtgaataccagcgcaataccgaacaacaccactccggatgcggcgacgcctgtccaacgggtaataccgtccaggagtaacgcggataaaagcgcaaagatgaacgcattggccgggataaaccaggcggcaggaataccgggaataccgatccccaacacaatcgccagcgcagcgccaaaagccgccgcggacgatacgccaagggtaaacggcgtcgccagcggattatttaaaatggtttgcatttcggcgcccgctaaccctaacgccatgcccaccagtagggccatcagggcatagggtaagcggatatcccagacaataacgtgtatgcccgcattcaccttttccggctggaaaagcgcctgccacagcgcactgagcggtaaaccagaagacccacaggttacatccaccatcagtgaaaccatcatcgccagcgcaatagctgacatgagcacggcccgtttgcgtatgatctggcgatagcgcggaatgacgggcgtggaagcgagaccgggggctaaaagtgatttgtcctgacaggtcatggttcgagcgacgttattaatcagaagagaattatagcgccgaattatttcgttatatatttatttatatttcgattgatgacacggtgggctatctcatcggtttccagtaaaaaaccggccttgcgggccggtttaagacgtaatgaagattaacctcgacgggcttttaccgctgccgacaactgacgaagcagcgcatcggtatcttcccagccaatacaggcgtcagtaatgcttttaccgtaggtcagcggctgaccgctttccagactctggtttccttctaccagatgactctctaccatcacgccaataatcgctttttcaccgcccgctatctgctgacagacatcggcgcaaacctccatctgcttttgaaattgcttacaggagttggcatggctgaaatcgatcatgacctgcggcgtcagtcccgctttgatgaggccttctttcacctcagcaacatgttgcgcgctatagtttggcgctttaccgccgcgcagaatgatatggcagtcgccgttgccgctggtattcacaatcgccgaatgaccccatttagtgacggagaggaagcaatgcggcgcgccggcggcgttgatggcgtcaatggcgactttaatcgtgccatcagtaccatttttaaaaccgaccggacaagagaggccagacgccagttcgcgatgaacctgggattcagtagtccgtgcgccaatggcgccccagctcatcagatcggccagatattgcggcgtgatcatatcgaggaattcgccggcggcaggcaggccgctgtcgttaatatccagcagcagtttgcgcgcaatacgcagaccgtcgttaatctggaagctgttatccatgtgcggatcgttaatcagccctttccagccgacggtagtacgcggtttctcaaaatagacgcgcatgacaatttcaagctcgccttgaagctcatcgcgtagcgccagcaaacgggcggcatactctttcgccgctgccggatcatgaattgaacaaggaccgatcaccaccagcagacgatcgtcattgcctttgagaattttatggatggctttgcgtgcgtgagcaacggtatttgctgcattttccgtggcgggaaacttttccagcagcgcgaccggaggtaataactcgttgatttctttaatgcgtaaatcgtcattctgataattcatgtttattccaatgttgccgtacttatcccaatgaatgcaatccctccaatctatctcttcaattaaatagtgtaaacgggcttttacactttgaacggaataatcctggaattcaggaaaaaaacgcacaaatgtagcggaaaatgggatctaacctacactttttaactgtaaccactctgtttatgaattattgcaagattctctgctgcgttaacccgcggcggcgaacgctttttatcccttatttgaggatttgactgacacgtgcactgttggaagaggttatccgacatatccaccataacaggagcatcttatgaaaatgacaaaactgactacgcttttactcaccgctaccctcggccttgccagcggcgcagcgttagctgctgaatctaacgcgcagtccagtaatggccaggcgaactcggcggcaaatgccggtcaggttgccccggacgcccgccagaatgtggcgccgaatgatgtgaataacaacgacatcaataccaacggcaatactaacagcacgatgcagcatcctgacggttcaaccatgaatcatgacggaatgaccaaggatgaagagcataaaaataccatgtgtaaagatggtcgctgcccggatattaataaaaaagtggaaaccggtaatggcgtcaataatgacgtgaataccaaaaccgacggtaccacgcagtaattcagaaaaaagtctgataacgggagagctttcgctctcctttttattttgtcagcgaaaaatcagtatgatatctacagtattgatgagaataacaaaggaatgacgttatggcgcactcacactctcatgccgattcacacctgccgaaagataataatgctcgtcgcctgcttttcgcctttatcgtcactgccggatttatgctccttgaggtggtgggcgggatactctccggctctctggcgttgttggcggatgcgggacatatgctcaccgacgcggcggctcttctctttgcgctgctggtggttcaattttcccgtcgccccccgactgttcgccacacttttggctggctaagactcaccacactggcggcctttgtgaatgccattgcgttggtggtcattacccttctcattgtctgggaagcgatagagcgcttttacacgccacgtccggtggcgggcaatctgatgatggtgattgcggtcgcgggtctgctggcgaacctgtttgcgttctggatactccatcggggaagcgatgaaaaaaacctgaacgtgcgcgctgccgcgctacatgtgatgggcgatttgctgggttccgtcggcgcaatagtcgccgcgttgatcattatctggacgggctggacgccagcggacccgattctctctattctggtttcggtactggtactacgcagcgcctggcgtttgttaaaagatagcgtcaacgaattgctggaaggcgcgccggtttcactggatattaatgccttacagcgccatttaagccgggaaatccccgaagtccgcaacgtacaccatgtgcatgtctggatggtcggcgaaaaaccagtcatgacattgcacgctcaggtcattccgccacacgaccatgatgcgctgctggaacgtatccaggatttcctgatgcacgaataccatattgcgcacgctacgattcaaatggagtatcaaatgtgtcacggcccggactgtcacctgaatcagacgccatccgggcatgttcatcaccattaacgggaaagcgcgcgcgatcctcgctcccgcgcgctgtttatccacaggcgactaccgttcacggcgataaatgtcaggatcagatattccagcgacatcgcatagacgccctgcaaagcaaaaatcaccacactgattacgttgattatcacccacaggagccagttttcgacatatttgcgtgtcatcaaaatcatcgccacgatagacagcaccatcatgcaagagtcccagaacgggaaagcgtccggttgcagtacaggcattgtcacctgtaaccccagcatctgcataatggcgacggccacgcgcgtcaggacggcgaatacgggatcgatatatcgcgtcatcaaaccgatagctatcacacatatcgccagccatgccattgcttttggcaacggcagccagcgtattttaagctcggcctcattatcctttgtttgccgcgaccacgcataccagccataaatattggcggcaaagaaaaagagttgcagcaacaggctggcataaagctggatctgaaagaaaataatcgcaaacagggtgacgttaaccagtccaaaaaagtagttgctgatattctccagactggcaagccaaatacagagcaggccggcgatggttcctaccgcttcgatccatgagagatcgtacccgccagcgccaatcggaatatgaatcagtatgttgtgcgtactaaaaaaatccattctctcccccaaagatttccgtctttacacccgaagtgtagccgcaaaatccagcatccggttgaggggaagtaatgcgctctcgcgtagcgccgcatcaacctgtatttcatgcgccgcgcctccctgctccagcccttcagcaatggctttcaggccgttcatcgccatccacggacaatgcgcgcagctgcgacaggttgccccttcgcccgccgttggtgcttcaagcaactctttatccggaaccgcctgctgcattttgtagaagatgccgcgatcggtcgcgacgataagctgtctgtgcggcagcgtttttgccgccttaataagctgactggtggagcccaccgcatcgcccatctcgacaatggaccgcggcgattcagggtgaaccagaatagcggcatcgggatagattttttttaaacgggtcaacgcctgggttttaaactcgtcatgcacgatacacgccccttgccaacacagtacatcggccctggtctgtttttgcacgtaattccccaggtgtctgtccggcgcccagataattttttcccccaaactatccagatgctcaatcagttctacggcgatactggaggtcacaacccagtccgcacgcgctttaacagcagccgaggtgttagcatagaccactacggttctgtcagggtgcgcatcacaaaaagcgctaaattcgtctattgggcagcctaaatccagcgaacattccgccgccagcgtaggcataagaacgtttttttccgggctgaggattttggcggtttcccccataaaccgtacgcccgctaccagtaacgtggatgcggcgtgcttcgcgccgaaacgggccatttccagcgagtcggaaatacagccgccggtttcttctgctaactgttgaatttccggatcggtgtagtagtgcgccaccatgacggcattgcgctctttgagcaaacgcttgattttctcacgataaaattgcttttcatcgtcgttcaacggcgttggtttcggcgggaacgggtagattgcggcttgtgagtcaaacattacgctcatcgtggcttctcgttttactgacttaacgaaacaaccgaatgaaagcgtaataaacgccacaatcggtcaatttgttttatatgctaaacaagatagctgattcaataaggaaagtcacaataattacgtagtccgtatctgatggcggcgtaacgtcttatctggcctacgtgagcggtgccgtctgtaggcctgataagcgcagcgcatcaggcaagacccgaacctgcggcaggttcgaatcttccatatcgcagatagcaaaaaagcgcctttagggcgcttttttacattggtgggtcgtgcaggattcgaacctgcgaccaattgattaaaagtcaactgctctaccaactgagctaacgaccccttggataagggttactgcttcaatcattcaggatggtgggtcgtgcaggatgactcggcttcgcctcgcccttcgggccgttgctaaagcaacattatccttcacgttctctaccagttaccaccttgtatattggtgggtcgtgcaggattcgaacctgcgaccaattgattaaaagtcaactgctctaccaactgagctaacgacccatacgggtgctgcctgaaagattttactcggaccatctaaagatggtgggtcgtgcaggatgactcggcttcgcctcgccctacgggccgttactgacgcaacgttatccttcacgttcaacatctgagtttgatgttaaattagtgggtcgtgcaggattcgaacctgcgaccaattgattaaaagtcaactgctctaccaactgagctaacgacccacttttacgttgctttcgagttgtttaatatcccgtggcaacggcggcatatattactgatttcagatttgagcgcaacaaaaatttcgacgcagagggctcaactgcttaggaatcgcacgacgcgaccagaaaaaaggcgttttctggtcgcatggtacgcattacatcgcgttaagacgcttctgcgcctgtttcgcgccatcagtgccaggatatttgttaatcacctgctgataaaccgctttcgcttttgccgtatcacctttgtcctgcatgataacgccaactttgtacatcgcgtccgcagccttcggcgacttaggatagttttttactaccgaggcgaaataataggcggcgtcatcttttttacccttgttgtaattcaactggcccagccaataattggcgttcggctgataagtagaatcagggtatttcttgatgaagttctgaaacgccacaatcgcatcatcctggcgagacttatcctgcaccagcgcaattgccgcattgtaatcggtattcgcatcgccactttgtaccggcgcccctgaggttgccgtaccggcatccggagcgggggtcgcagcggttgccgccccgctctggtcgccagctgctggctgcgctgcgccgccattatttaaactccccagctgcagcataatttgcttctggcgctccatcacctgattcagttgatactgattttcctggatttggccgcgcaaagaatcgatatcagactgattatcggagagctgctgctgaagttgggttaaaagctggctgtgagcgttagagatacgctcaagttgagtgacgcggtcttcgaccgagcctgagccgacactactgattggcgcctgagcaaaagcggcccagggggccgctatgccaaccagtaacgacagactcaacaggtgatgtctgaagttactgctcatgcaattctcttagtaaaccagtacagcgcgacggttcttagcgtaagccgcttcgtcgtggcccagtacggcaggtttttctttaccgtaagaaacgatggagatctggtcagcggaaacgcctttaccctgcaggtacattttaacggcgttagcacgacgttcgcccagggagatgttgtactccggagtaccgcgttcgtccgcgtgaccttctacggtgactttgtaagacgggttgctacgcaggaagttagcgtgcgcatccagcattgccgcgaagtcagaacggatatcgtacttgtcgagatcgaagtaaacgatgttgttctgctgcagctgctgcatctgcagacgcgcttgctcttcagatgacatgttgccgttgccgttagcgtccataccagtgccggcgccgttcagcatgccgccttcgctaccgtcattgctggcgttcttgttggaagaacatgccgcgattgccataacaggcagggcaatcatcaggcccttcagcactttgttcagttgcatttctttaattcctttagtaatcaattaattattatcacagatacggcgaccaggcaggcgatttcacctgaccatcagttgccggaagacgcgctttgaaacgcccatctgtagaaaccaaattcagcacagatcccatcccctgagaagagctgtagattaccatcgtgccgttaggtgccagacttggcgtttcatccaggaacgttgacgacagaacctgtacgccacccgtcaccagatcttgtttggcaatgtgctgctgcccgttatttgagcttaccattaccataaatttaccgtcgctgctgacatccgcatcctggttttgcgaaccttcccaggtaatacgctgcgccgcaccgccgttaatgttcattttatacacttgcggacgtccagcctggtcagaagtaaaggccagagtctggctgtccgggaaccaggtcggctccgtattgttgctacgcccgtccgttatctgacgaatctgaccggaggcgagatccataacgtacaggttcagacttccggttttcgataacgcgaacgccagtttcgtcccatccggcgagaaggccggcgcgccgttgtgacgcgggaaggacgcaacctgacgcactgcgccgtttgccagcgtctggataaccagcgcggagcgaccgctttcaaaagtcacgtaagccagttttgagccgtccggagaccacgccggagacatcaacggctgcggagaacggtgcactacgaactgattgtagccatcgtaatccgacacacgcagttcatacgggaactgaccgccgttagtctgtaccacataggcgatacgagtacggaacgcgcccttaatgcccgtcagtttttcaaagacttcgtcactggcggtgtggcctgcataacgcagccactgcttgttcactttataggagttttgcgccagtacagtccccggcgcaccgccagtgtcaaccagctgataagcaacattgtacgaaccgtccggattcggcgtgaccagtccaacgatgacggcatcaatacccagcgcagaccatgcggtaggctgaacttcctgagcggtggctggctgctgcggcagtcgggaccggtctaacggattaaatttaccgctattgcgtaaatctgccgccacgatgccgccgatatcttcaggcgcagcgcccggcccggcccatttaaaaggcacaacgccaatcggtcgcgccgagtccaccccctgggtgatctcgatacggacttctgcgtgcagcactgccgcccacagcatcagaaaaccaaatgctactcgtaatgcctgcttcatcatatctcccatacctgggcctgcgacccacgataatttagcagaatgttaacaaactcaaatacacaaaaccaccaggaccagtaacaactcaaccgctccaacttccataaagaaaagtatctacagtttaaagtctagtttggcatcctttattttctcataaacagcctggcttggcggtttaggaattttcgcggtttttgtcgccattaacgccgcctgacaaagcgccggatcgccgccctcagacgtaatgctttttaatgagccatccggcgccaggctaatatgcaagacacattgtttgccctgatacaggctcgcatcatacagacggctctgaatggcgacctgaatctgtttcgcgtaggcgctgatatcagcgcctgtcgtcccaccgttagcgcccgatgtaccgctatctttcgatggctgaccattccctttcgcgccgccgccggttttcggcgcattcttacccgagctgagatcgccaagcagatcgtcgacgccttctgcggcggccgctttttcggcagccgctttcttcttagcgtccgccgctgctttcgccgcctcggcatccgctttcttcttcgcctccgccgccgctttcgccgcctcggcatccgctttcttcttagcgtccgccgctgccttcgccgcttcggcctccgctttcttcttcgcctccgccgctgctttcgccgcttcggcctctgctttcttcttcgcgtccgccgccgctttcgccgcctcggcctctgctttcttcttcgcgtccgccgccgctttcgccgcctcggcctccgctttcttcttcgcgtccgccgccgctttcgccgcttcttcggcctgttgctgctgttgcgccagttttgccgcttcttcagcctgcttttgctgctcctgagccgctaaacgttctttctcaagttgtttcaaccgctcctgttcagcagcctgcttctgctgcagctcctctgcttgctgctgttgcagctttttacgctcttcttccgcgcctctggcactggcctgttgatcctgctgacggttgtactgctgcacaacggcgccaggatcgaccatcaccgcgtcgatagcggaaccgccgccgccgccggcagaagcctctatatgctcatcaaacgaactccagatcagcactgcaaataagatgatatgcagcacggctgaaataattatcgcccgtttgagcttgtcgttttgttcggttgcctttgacactctcggttcccaaaaaactgttcgcctgttactcgccgtctttcaagccaacgggacgcagacttcagattggctgcgtcattaagccaaccgattttacgcccgcgctgtgtaacaagttcagcgctttaattatttcatcgtacggcacctctttcgcgccgccgattaaaaagactgttttcggattagcctgcagatgacgctttacttctgcgatcacctgttcagacggcagttgatccattcgatctttatcaaccactacgctgtattgccctactccggaaacctcaataatgaccggcggatcgtcgttactactgaccgcctgcgactgattcgcctccggtaagtcgacttccacgctctgggtaatgatcggcgcggttgccataaagatcagcagcagcaccaacagtacgtcgagtagcggtacgatattgatttcggacttaagttcgcgacgacctcgtccacgcgttctggccatggcttaccccttgttgctttcgcttacggtaaacgcctggcggtgcagaatcgcggtaaactcttccataaagttgtcgtaattcagttccagcttgttcacgcgctgattcagtcggttgtaagccataaccgcagggatagcggcaaacagaccaatcgccgtggcaatcaatgcttcggcaatacccggcgcaaccatttgcagagtcgcctgtttcaccgcacccagggcgataaacgcatgcataatcccccatacggtgccaaacagaccgatataaggactgatagagcctaccgtgccaagaaacgggatatgcgtttccagcgtttccagctctcggttcatggagatgcgcatcgcacgcgacgccccctctaccactgcctccggcgcatggctgttggcgcgatggagccggacaaactctttgaacccgctataaaagatttgttccgagcccgacagactatcgcgtctcccctggctttcctggtacagacgcgatagttcgattccggaccagaatttatcttcaaacgcttccgcctcacgcgcagcggcgttcaggatacgcgttcgctggataatgatggcccaggatgctattgaaaaaccaatcaaaatcaacatgataagtttaactagaaggcttgccttcaggaacaaatcaaggatattcatgtcagtcactgcttaaactccgcgacaatagacttaggaagcgcacgaggcttcattttgagtggatcaacgaaaacaatcagaacctctgcttcatttagcagcgtgttctctgcgttgacaatgcgttgcgtgaaaaccaaagcggtgccacgcattgacgtaatttctgtttgaacttcaagcatatcgtcgagccgcgcaggcgcatagtattccagcgtcatcttgcgcaccacaaaggcgacccgctccgccagcagcacctgttggctgaagtgatggtgacgcagcatctccgtgcgcgctctttcataaaaagcgacatagctggcgtgataaaccacaccgccggcgtccgtgtcttcgtaataaactcgaattggccatcgaaacatatacttattcatccctgcagcctctttgttggcgtcatccgcttgccgccgtaatgcctcaagaatgccgttgtatatcgccttgtattcactttacatcccggtaatgcaacaaaagtagagcttttaaacgttgctactatacgcgtaggaatgaggcttgggaatggggggaagttaagggagagtaaaaatatatgggcttatgcaagcccctatatttttaaggaggtttcttattcacaagaagaagaaaatcaggccgacgataaggacgatatccgcaaggagcggacaaaaaatcccttgccagtgtacggattcagggcgaaaacccacgccgtggattatgcctgcgcaaaccgcccacatcagcaataatccgtgccagatttcaagcgtgctggtcctggcggcaaaccgtaacgggtcccagaacatacatcctgccagcactatcgccatcacgaaggaaagcgcccttaagaggcgcttgtccattaccgcataaatatacttcatcctctaagctgcctctttgttggctgcggctgctcaccccagtcacttactgatgtaagctcctggggattcgcagccttgccgccgcgatgcaacttaaatgattttgtatattgcatagcgacaatatgaatcattagctttcttcttgaccggttttacccgcttcaacgtgctcaagcgccagggcggtaatgatcccgaatgcacaggcaagaagcgttcccagaatccatgcgaaataccacattttaagctccttacttagtacagagagtgggtgttgctttcaatatgttctttagtgatacgaccgaacattttccagtaacaccagctggtgtagatcagaataatcggtacgaacaccgccgcaacccaggtcatcaggttcagcgtcatctggctggatgtcgcatcccacatggtcagactggcattcatcatcgtgctggacggcatcacaaatgggaacatagcgatacccgccgtcagaataatgcaggccaacgtcagcgaagagaacaggaatgcccacgcgcctttctccatacgggaagtcaggatagtcagcagcggcagaaccacgcccagagccggaaccaaccacaggatcggagcattattaaagttcactagccaggcgccggcttcgcgcgccacttctttagtcagcgggttagaggcagcatgatgatcaatcgcggatgtcacgacataaccatcaataccatacattacccaaacgcccgccagcgcaaagcacactaatgtcaccagcgccgcaatctgcgaggtggcgcgcgcgcgcaggtgcagttcgccaacggtacgcatttgcaggtaagtcgccccctgcgtgatgatcatccctacgcttacgatacccgccagcagaccaaacgggttcagcaactggaagaagttaccggtatagtacagacgcagatactcatccacatggaacggtacgccctgcaacaggttgccaaaggccacgccaatcaccagcggcggcacaaagctaccgatgaacacgccccagtcccacatgttgcgccagcgcgggtcttcaatcttggaacggtaatcaaaaccgaccggacggaagaacaaagacgccagcaccaggatcatcgccacatagaaaccggagaacgccgcggcgtaaaccatcggccaggcagcaaacaacgcgccgcccgcggtgatcaaccacacctggttaccgtcccagtgcggggcgatagagttaatcataattcgacgttcggtatcgttacgaccgaggaaacgggtgagcatccccacccccatgtcgaacccatcggtgacggcgaaaccaattagcaaaatgccaaccagcagccaccagataaaacgtagtacttcataatcgatcatttgacgactcctgtcttagcgtgccggctgagaagtcacggtggactgctcaaagtgatagcgaccggttttcaggctgcttgggccaaggcgtgcaaatttgaacatcaggaacaattctgccaccaggaacagggtatacaggccgcaaatcaggaacatggagaacagcagatcgcccacggtcagcgatgagttcgccacggctgtcggcaacactttgccgatcgcccacggctgacgaccatactcggcgacgaaccaacctgcttcaaccgcaatccacggcagtggaataccgtacagcgccgcacgcaacagccattttttctcaccgatgcggttacgaatcacgctccagaaggaaagtgcgataatcgccagcagcaggaagccgcacgccaccatgatacggaaagcgaagtacagcggcgcaacgcgaggaatagaatctttcgtcgcttgctggatctgcgcttcggtcgcgtcagtcacattaggcgtatagcgtttcagcagcaggccgtaaccgagatctttcttcatgctgttaaactggtcgcgaacggcctggtcggtagaaccggcgcgcagctgctccagcagctcataagctttcatcccgttacggatacgctcttcatgctgaaccatgagatctttcaggccaataaccggcgtgtccacggaacgcgtagcgataatgccgagcgcataagggatctgaatcgccagatggttttcctgtttgtcctggtcaggaatgccgaacagggtaaaggaggccggagcaggttgcgtttcccattcagcttcaatcgcagcgagcttggttttctgcacgtcgcccatttcgtaaccggattcgtcaccgagtacgataacggacagtacggcagccataccgaagctggcggcaatagcaaaggagcgtttagcaaaggcgaagtcacgacctttcagcatgtagtaagcgctgataccgaggatgaacatcgcgccggtgacatagccggacgccacagtgtgaacaaatttcacctgtgctaccgggttcagcaccagttcagagaagctcaccatttccatacgcatggtttcgaaattgaaatccgcagcgattgggttttgcatccagccgttcgctaccagaatccacaacgcggagaggttggaccccagagccaccagccaggtgacgcacatatgctgaactttacttagacgatcccagccgaagaagaacagacctacaaaggtggattcgaggaagaaggccatcaaaccttcgatggccagcggcgcaccgaagatgtccccaacatagtgggagtagtacgaccagtttgtcccgaactggaactccatggtcaaaccggtagccacacccagagcaaagttgataccaaacaacttgccccagaacttggtcatatctttataaatctgtttgccggaaaggacgtataccgtttccataatggccagcaggaacgccataccgagcgttagcggcacaaacaggaagtggtacatcgcggtcaaggcaaactgtaagcgcgacagttcgactatatctaacatcatgactccttgctcatcgcatgaagactccgagagtgaaccccgttagaaagggtcacacgcatgccccaatacaaatttatttgcggccttccatcgtactatcccctcgggaaggaaacagtaatgatgaaaagttacaaacatgttaataaaaaacccaaattgatcccgcaaatatattacgccgtaaaacccttacaataaacaggtttttagtgggtcagatttgcttttttcgacagcgatcaatttatggctaatctatcgcttttcagggaatttgatcacggacaatttaaccagttttgatgctcttttccaacatttaaatattgattaaaatcaatttttaaagttaatgttaataatgtttattcattgaatgcatggtgaattttttgttaactttttgtttttgcaaagagtaatttcaaaccccctgtaaaaagaggcttattcgataaggctaaacattttgtgcgttttttactgccccgcatccagtaaaaaacattccacattgatgttcaattattgctaaatagctcacagattttttctgcaggttatcaccacttattattttatacatttagtctatttttattttacttataattaacaccgcaaagaaactatctcattgcacacgcgccatcatcccaccgggattaccctgcccgaacttccctttcccgacgactaatggccaggatcatcttaccaggttatcgccttaattatcgctaataagccttccagatagccaggatcaaacaaacattttattagctactttttctttatttcaacaacaccgtatttacctccccataattattatagcgaagattctgtcatcaccttcacagattaacccttaatttctacgtcactcatagtgataattctgtttattcgcagccataaataccctttaaacatgattaatcacgaacgcatagtgtcaataagttcttaataatttttaaagttaacctcttttaaccagcaaaagttcatataatttattaaacgatatctttaatatttcagggaaataatgccggtactcttatgattaaaatagctgttttattctgccattaaacaagcagtctgtgtaagcgcgatacatctgaggagacgtgtagttcgcgctcaggcaaacatgcgcggccacagagtcaagcgtcaatttactatagaggttagcatcaacatagtgtaatgctgcaatgcgtttttttcatggcggaaagcgcataatccgtctccagtgaggtcggcaggtctttcactaagacagcatctgtatttgctgaaaaagagttaaccggcaaactgagtaaatttactgccgctgccagacggttattatcaattattttcagactccaccatgtttttttaatgagtcatcattttcctatacctcaatatttacaaagccaataattttatatcccggatgcttcacccgtactttgccacaaacaataaaaccataaaaaaggccaccgtaaaggtggccaaccatgtcgaaaacggacatttatctgttcccgcaggaacagcgagtttttattttataattgctttcagcgcttcgccgatatcggccaggctgcgaaccgtcttcacgccagccgcttccagagcagcgaatttctcatcagcggtacctttaccaccggcaatgatggcgccagcgtggcccatacgtttgcctttcggcgcggtaacgcccgcgatatagccaacaaccggcttggtcacgtggtctttaatataagccgccgcttcttcttccgcgctgccgccgatctcgccgatcatcacgatcgcttcagtctgcggatcttcctggaacagtttcagaatgtcgatgaagttagagcccggaatcgggtcgccgccgatacccacgcaggtggactggccgaaaccgtagtcggtggtctgcttaaccgcttcataggtcagcgtgccggaacgggaaacgatacccactttacccggcttatgaatgtgacccggcatgatgccgattttgcattcgcccggggtgatcacacctgggcagttcgggccgatcatgcgtacgcccgcttcgtccagcttcactttcacggtcagcatatccagcgtcggaataccttcggtgatggtgataatcagtttgatgcctgcgtcgatcgcttccagaatggagtctttgcagaacggcgccgggacgtagataacggatgcggtcgcaccggtagcttctaccgcttcgcgcacggtgttgaacaccggcagacccagatgcgtggtgccgcctttgcccggcgttacgccgccgaccatttgcgtaccgtaagcaatcgcctgttcggagtggaaagtcccctggctaccggtgaagccctggcagataacgttggtatctttattaattaaaacggacattatttcccctccactgcggcaacaacctgctgagctgcatccgtcagacttttcgctgcaataatattcaggccactgtcagccagtttcttcgcgccgagttcggcgttgttgccttccagacgcaccaccaccggaacgttcacgcccacttcttccaccgcgccgatgataccgtcggcaatcaggtcacaacggacgataccgccgaagatgttaaccagaaccgctttcacgttgtcatccgagaggataattttaaacgcttcggtgacgcgctctttggttgcgccgccgcctacgtcaaggaagttagccggttcgccgccatgcagcttaacgatgtccatggtgcccatcgccaggcccgcgccgttcaccatgcaaccgatgttgccgtccagcgcgacgtagttcagttcccactgtgccgcctgcgcttcacgcgggtcttcctgagactggtcgcgcatttcgcgcagatccggctggcggaacagcgcgttgccgtcagcgcccagcttgccgtcgaggcaaatcagatcgccctgcttagtgatcaccagcggattaatttcgattagcgccaggtcgcgctcaagaaaaatggttgccaggcccataaagattttggtgaactgctgcaccagtttaccttccagacccaatttgaacgccagttcccgtccctgatacggcatcgggccggtcagcggatcgagcgcgactttatggatcagatgcggggtttcctccgcaactttttcgatctctacgccaccttcggtagacgccataaagaccacgcgacgagaactacggtcaaccaccgcgccgaggtacagttctttgccgatgtcggtcgccgcttcaaccagaatctggtttaccggttggccattagcgtctgtttgataggtcaccagacgtttgcccagccagttttccgcaaaggcgcgaatctcttctttgctttttactaccttcacaccgcccgctttgccgcggccgccagcgtgaacctgacatttcactacccacgggccggcaccgattttagacgcggcttcttcggcttcacgcggagtagtacaggcataacccaccggcgccggtaagccatagcgggcaaaaagttgttttgcctgatattcatgtaagttcatgtgttctgtccatccttcaggtaatcgttatctttagacctgtaggcctgaaagctgcgcgccatcaggcattacaccatcgccggatggcggcgtgaacgccttatccggcctacaggtagcaggtgatgctcttgctgactacacgtccaacagcagacgggtcggatcttccagcaactctttgatggtgaccaggaagcccacggattcgcgaccatcgatcaggcgatgatcgtaagagagcgccaggtacatcatcggcaggatttccaccttgccatccaccgccatcggcctgtctttaatagcatgcattcccagaatcgcgctctgcggcgggttgatgatcggggtagacatcagcgaaccgaatacgccgccgttggtaatggtaaagttaccgccggtcaggtcttctacggtcagcttgccgtcgcggcctttgacagccagttctttaatttttttctcgatgtcagccatgcccagcgtatccacgtcacgcaggaccggcgtgaccaggccgcgcggcgtagacaccgccatgctcacatcaaagtagttgtgatacaccacgtcatcgccgtcgatagaggcgttcacttccggataacgcttcagcgcttccactaccgctttcacgtagaaggacataaagcccaggcggataccatgacgtttttcaaacacttcgccatactgcttacgcaaatccataatcggcttcatgttgacttcattgaaggtcgtcagcatggcggtggaatttttcgcttccagcagacgctcggccacgcgcttacgcaggcgggtcattggcacgcgtttttcgccgcgcgcgcccagagcgggttgtgctgcaggttcaacagcgggtgctttagactcgcctttcgccagatgtttttccacatcttcacgggtcagacgcccacccacaccagtgcctttaatggcgctggcttccagattgtgttcagccagcaggcgacggatcgccgggctgagcgcatcgttgttttgttcttccagcgacgcctgctggcgctgtgccggcgtagacgctttctcttcagatttcgcgctggtctctttacccgcgctgttgccttcacgcaggcgacccaggatctggcgagaggtgacagtcgtcccctcttcttccagaaccgcatccagaatgccgtccgctgatgccggtacttccagtaccactttgtcagtttcgatttctaccagcacttcgtcacgaacaaccgcatcgcccggttttttatgccaggtggcgacggtcgcgtccgctacggactcaggcaggtcgggaacaagaatatctacgctactcattatttatcctttatttaatcgacgttcagcgcgtcattaaccagatcttgttgctgtttctggtgaacggacatataccctaccgccggagaggcggaggccgggcgacctgcataacgcagagcggccccaaacggaatcacttcacggaaatgatgctgactgcagtaccatgcgccctggttgagcggctcttcctggcaccagacaaaatcatggacgtgagcgtatggttgcagcgcttcctgcaccgctttatgcgggaacggatagagctgttcgatgcgcacgatagcgacatctttctggtcgtttttgcgacgttgttccagcaggtcgtaataaaccttaccagaacacattaccacgcgttttacggctttagggtccagctcgtcaatttcgccaatggccggctggaaggaaccgttcgccagttcatcaagcgtggaaaccgccagcgggtgacgcagcagcgatttcggcgacatcaccaccagcggacgacgcatcccgcgcagcgcctgacggcgcagcatatggtagacctgcgccggagtggacggtacgcaaacctgcatattctgctcggcgcaaagttgcagataacgttccagacgcgcggaggagtgctccggcccctgcccttcatagccgtgcggcaacagcatcaccagaccgcacatccggccccatttctgctcgccagaggagatgaactggtcaatcactacctgcgcgccgttggcaaaatcgccaaactgcgcttcccagatagtcagggtacgtggttccgccgtggcataaccgtattcaaaagccagtaccgcttcttcagacagcacggagtcccagactttaaactgtccctgaccgctgtgaatatgctgcaacggcgtatacgttgagccgttcgtctggttgtggatcaccgcatgacgatggaagaaggtgccgcgaccggagtcttccccggacaggcgcaccggaatgccttcatcgaccagcgtggcgtaagccagattttccgcgccgccccagtcaaacaatttctcgcctgccgccattgcctgacggtcgccataaattttcgccacgcgagactgcatttcaatggcttccggcacggtgctgatacgttttgccagctcctgcagacgcttcatttctaccttgttcgggtatgcttcatcccattcgtggtttagatacggcgaccaggtgaacgagtgcatattcatcggacgccactctttcaccacgcattcgcctgcatccagcgcatcgcgatagaggttgaccatttcggtggcatcttccagcgttgcgaccttatcagcttccagcttgtcggcgtagattttacgcggcgtcggatgctttttgattttctggtacatcagcggctgggttgcgcttggctcgtcggcttcgttgtggccgtgacggcggtagcacaccagatcgatgaacacatcgcgtttaaaggtattacggaagtccagcgccagacgggtcacaaaagcgacggcttccggatcgtccgcattgacgtggaaaatcggcgcctggaccattttaccgatatcggtgcagtaaggcgttgaacgcgcatccagtgggttagaggtagtgaagcccacctggttgttgataacgatacgtaccgtaccgcccacttcgtaaccgcgcgctttcgacatgttcagggtttcctgaaccacgccctggccggtcaccgcggcgtcgccgtgaatagtgatcggcagcactttattactgctcggttcgtccagtcggtccagacgggcgcgcacggagcccatcaccaccgggctcacaatttccagatgcgatgggttaaacgccagcgccaggtgaaccagaccgccttcagtttcgatatctgacgagaagcccatgtgatacttcacgtcgccggtacccagatgttctttatgtttaccggcaaactcgtcgaacagatcctgcggttttttacccagtacgttgatcagcacgttcagacgaccgcggtgcgccatccccagcaccacttcgcgagtgccgctgttacccgcatggcgaaccatctctttcagcataggtatcagcgcatctcccccctcgagcgagaaacgtttcgcacccgggaatttggcgcccagataacgttccagcccttcagcggcggtcagttcgttcaggaagcgttttttctcgtcagcgctaaaggccgcacgaccggattcgatgcgctgttggatccagcgtttctcttcggtgctggtgatgtgcatatactcagcgccaatcgggccgcagtaggtctgtttgagcgcgtcgagcagctcccccagcttcatcgtctctttgccgctggcaaaggagccgacattgaaggtttcctggaaatcggcctcggtcaaatcatggaaagaagggtccagatccgccacgcgttcttgtttccacagtcccagcggatcgaggtttgcatgctgatggccacggaaacgataagcgttgataagctgcaggactttaacctgcttcacattggtgtcagggtcggaaatcgtagaagagtgacgtgagccagccaacgcctgccgccggaaatattcacgtgtttttgaatggagttgatccggtttgactccggtaccaggtaactgctggaacgtcaaacgccagttagcgtctaccgagtcaggatcggttaagaagtcttcatagagctgttctatccagctctgattcgaaccagagaggtaagaagagtccaaccaggctttcaaagcgctgttctgcatcgtgatcccttaagcatcttttctgcttatttaatactctaaataggtcacgtttcaggaaggcggcaagcttgcgaatccctgggagcttacatccagtaagtgactggggtgagcaagtgcagccaacgcacatgcaacgtgaactatgacgagtatttcgccgtggatactaaccacgcatacgctgtatgcgtgccggggttcacttgttgcggactgtcgtgtcatctgcgtccgctaaggaacctttaaaaactgtctaataatcttcgctgttcaggctacgactgcgttgcggccttcgctcactccggtcacatagttatctatgctcccgaagattcgttcagaccgcgccttgtctcgctctgaacatctcgattattactaatcatatggcagtttttagaggtttcctgcacttctattgcccgatggcacctggcttatcaggcctacagaatacgtaacccgtaggccggataagacggtacgtcgccatccggcaaccactacaactacttacgcgctacgctgcaacagcatcgacttaatatggccgatagcgcgcgtcgggttcagtcccttaggacatacactgacgcagttcataatgctgtgacagcggaatacgctgaatgcatcgctcatcccttccagacgactgtcagtctcggtatcacgactatcgatcaggaatcgatacgccgcgagcagccccgccggaccgataaacttatccgggttccaccagaatgacgggcaggatgttgagcaacaggcgcaaagaatacattcatacagcccatcgagtttttcacgctgctccggcatctgtaaatgctcacgtgccggtggattttgcccattattcaataagtaaggcttaatcttctcatattgtgcgtagaattgccccatgtctaccaccaaatcgcggatcaccggcaaaccgggcagcgggcgaatcacaatcttcttacccgactgagtcagcgccgaaataggagtaatacaggccagaccattcttaccgttcatattcaaaccatcagaaccacacacaccttcgcggcaggaacggcggaaagaaaggctgggatctttttctttaagctggattaacgcatccagcagcatcatgtcgcgcccttcttcgccttccagggtgtaatcctgcatacgcggagcgttatcgacatccgggttataacgataaatcgaaaattcgagtttcatcatcctgtctccgcaattaataagtacgaatcttcggcgggaacgccggacgcagtttcggttccatattgacgcttcggcgcgtcatggattccgtttgcggctgatacagggtatgacacaaccagttggcatcatcacgctccgggaaatcgaagcggctatgcgcgccgcggctttccgtccggaagttggctgatacggcagtggcgtaggcggtttccatcaggttatccagctccagacactcaacacgctgggtattaaactcgctggacgtgtcatccagacgggcgtttttcagacgctcgcggatcactttcaactgctcaagccctttcgccatcgcgtcgccttcacggaatacggagaagttatgctgcatacactcctgcaatgctttgcggatagccaccggatcttcgccattgcggttattgttccagcgattcaggcgatccagagaaccttcaacgtcagactcgctggcgtcgcgcagcacgccctgctcggcgatggattcctgtaaatgcagccccgccgcgcggccaaagaccaccagatccagcagtgagttaccgcccagacggttggcgccgtgaaccgatacacaggcgatttcgcctaccgcaaacagccccggaatcaccacgtcttcgccctgctcgttcacggtcagcgcctgaccggtcactttagtcggaataccgcccatcatgtagtggcaggtcgggataaccggaatcggctctttcaccggatcgacgtgagcgaaagtgcgggacagctccaggatacccggcaggcgagattccagcacctctttacccagatgatccagtttcagtttagcgtgcggcccccacggaccatcacagccgcgaccttcacggatttcgatcatgatggaacgcgccaccacgtcacgacccgcaaggtctttggcgttcggcgcataacactccataaagcgctcgccgtgtttgttcagcaggtaaccgccttcgccgcggcagccttctgtcaccagcacgcccgccccggcgatgccggtcgggtggaactgccacatttccatatcctgcaccgggacaccggcacgcagcgccataccgacaccgtcaccggtattgatatgagcgttggtggtggactggtagatacggcctgcgccgccggtcgccagcaccgtcgcgcgagctttgaagtacaccacttcacaggtttcgatgcacagtgcggtacaccccaccaccgcgccatcctggtttttcaccagatccagcgcataccattcggagaaaatcgtggtgtggtttttcaaattctgttgatacagcgtatgtagcaaggcgtgaccggtacggtcagccgccgccgcggtacgtgccgcctgctcgccgccaaagtttttcgactggccgccgaacgggcgctgatagatacgtccatcatcaagacgggagaacggtagccccatgtgctccagttccagaatcgcttccggtccggtcttacacatatattcgatggcatcctggtcaccaatgtagtccgacccttttacggtgtcgtacatgtgccattcccagttatcttcatgggtattgccgagcgccacggtgataccgccctgcgcggaaacggtatgggaacgggtcgggaagactttcgagagcagcgcacaggtttggccgctctgggaaatttgcagcgccgcgcgcatacctgcgccaccggcaccaatcacaacagcatcaaattctctgactggcagtttcattacacaccccacaccacaacaaatccatagatgacgtaaaccaccagcgcaacaacaataacgagttgcagtatcagacgcactgccagtggtttaacgtagtcggttaacacctgccacatgccgatccaggcatgaattaagatggaaaaaagcgccagcagagtgaagactttggtgaaggccgatgagaagaaaccggtccaggcttcaaaggtcagttcgccgctcgtggcgaaaaaacccaccatgtagatgatgtataacgtcagaacgatagcggtagcacggaccaggatgaagtcatgtacgccattgcgtcctaatgcggaggcgttgcttaccatacgaggactcctgcgagaagtgaaagcacgacagtgataacaaaagagattttggcagagcgttgacccgcttcgaatgtttcttccagatagccaaaatccattaacatgtgacgaattcccacgatgacgtgatacgccagcgcggtaaggatgccccacatgataaatttaacgatgaagccgtccatgatgtcggcggcctgctggaatccttccggagaagagaggctggtgcccagtagccacagtagtatgccgacggcgatgaaagtaatcacaccggatacgcgatggagaatggacgctatcgctgtgatggggaaccgaatcgtttgtagatccagattgacaggtctttgttttttcacatttcttatcatgaataacgcccacatgctgttcttattattcccttaagacttcggttacagaggtgaatctacctgtagccagaaagacgacgggatttccttcctccggtctgcgtgcgggtcagacagcgtcctttctataactgcgcgtcatgtaaaacactgcttccagtagctaaaacgacacgttacaacgctgggtggctcgggattgcagggtattccggagacctggcggcagtataggacgttcacaaaatcattacaattaacctacatatagtttgtcgggttttatcctgaacagtgacacaggtcacgataacaacatttttttaattttcaatcatctgatttgacaaacattaaacaaaattgttacaaacaacaccagaaaaagcatataatgcgtaaaagttatggggtcactctttcacctgttaataagttatgtaacagtacaatgatattgacccattctttcaggacagttattagtgatagacaggttacattactcggattgctacgttcctgatttgctgctaattcgaaattaatcaagccgttacctgcaaacgcccattgctctgtacccaggtcatcccctctttcacagagcggcgagccaaataacaaactggtaacggttgattgatgcatacacagaattttccctgcactaacgacgaggaagatgacgtggagaaggcaagtctgagttccggcagtcttaagcaataaggcgctaaggagaccgtaaatggctgatacaaaggcaaaaatcacccttactggtgacactgctattgaactggatgtgctaaaaggcacactcggtcaagatgttattgatattcgtagtctcggttcaaaaggagtttttacttttgaccctggtttcacctctaccgcatcctgcgaatctaaaatcaccttcatcgacggcgacgaaggcattttgttgcatcgcggtttcccgattgaccagcttgctaccgattccaactatctggaagtctgttacatcctgctgtacggcgaaaaaccgacgcaggaagagtatgacgagttcagaacgacagtcacccgccatacgatgatccatgagcaaatcactcgcctgttccatgctttccgtcgcgactcacatccgatggcggtaatgtgcgggatcactggcgcgctggcggcgttctaccacgactcgctggatgtgaacaatccgcgccaccgtgaaatcgcggcgttccgcctgctgtccaaaatgccgaccatggcggcgatgtgttacaaatattcaatcggtcagccgtttgtttatccgcgcaacgacctttcctacgccggtaacttcctgaacatgatgttctccacgccgtgtgaaacctatgaagtgaatccggtactggagcgcgcgatggaccgtattctgatcctgcacgctgaccatgagcagaacgcctctacgtcaacggtacgtaccgcaggttcaagcggcgccaacccgttcgcctgcattgccgccgggatcgcctccctgtggggacccgcgcacggcggcgccaacgaagccgcgctgaaaatgctggaagaaatcagctctgttaaacacattccggaatttgttcgccgtgcgaaagacaagaatgattctttccgcctgatgggcttcggtcaccgtgtttacaaaaactacgatccgcgcgccaccgtgatgcgtgaaacctgccacgaagtgctgaaagagctgggcaccaaagacgatctgctggaagtggcgatggggcttgagcacattgcgctcaacgacccgtacttcatcgagaagaaactgtacccgaacgtagacttctactccggcatcattctgaaagcgatgggcattccgtcctctatgttcaccgtgatcttcgccatggcgcgtaccgttggctggattgcacactggaatgaaatgcacactgacggcatgaaaatcgcccgtcctcgtcagctgtataccggctacgataaacgcgattttaaatcggcgctgaagcgttaattgacaaccggatggcgacgcaaccctcgccatccggtacattttcccttttttcttatcctcattattttattcttaccccgttactctctatgattaattaaggtttcgctaaatatcattcagggagcatggaatgccgattttgcagtggtttttgttgttcctgttatcgctgctcatttcccttatttttctctatctgcaccttccggcggcgatgctgcttggtccaatgattgcgggtatcgtgttgagtttgcgaggtagcacgctacaacttcctcgcggtatttttctcgccgcgcaggcgattctcggctgtatgatcgcccaaaatctaaccggttcgatattgaccaccctcgccctctactggccggtcgtgctttttgtgttgctggtgacgctgctttccagcgcggtagtcggctggctgctggtacgttacagctcgctgcccggcaacaccggcgcatgggggtcttcgccgggcggcgcggcggcaatggtagcgatggcgcaagattacggggcggatatccgcctggtggcgtttatgcagtatctacgggtactgtttgtggctggcgcggcggtgctggtgacacgcctgatactcggcgacagcgcggcaacggtcagccaacaggtggtctggtttccgccgcttagcggtaatttattgacgacgctgctattagcgatcgtggcgggcattgccggtcgcctgatgcgtatcccttccggcacgatgctgctccccatgttggcaggcgcgcttctccattcgcaaggcatcattgaaattgaattacccgaatggctgctggccgtggcgtatatggcgataggctggcgtattgggctgggttttgacagacaggtgttttttatggcgctgcggccattgccgcaaatcttattgtcaattttcgcgctgatggcgatttgcgccgcgatggcgtggggaatggcttactacatgcagattgattttatgacggcttatctcgccaccagtcccgggggtctggatacggttgccgcgatcgcggcaggaagcagtgccgatatggcgctcatcatggcaatgcaaaccctacggctgttcagcattctgttaactgggccagcagtggcccgttttatatcaacctatgcgcccaaacaacctttgtagggctgataagcgtcgcgccatcagacaatagccgctcgccgatggcggttccggctatttctggcaatgcgcgcaccagtaaaacgggcgtgaggaaagtgttgtcttttcaataatgccgccgcaccgctcgcacgcttcaccgtcacggtggaaaaccttaaagcgaaacagtgcgccatgatgcttgttctcatccgcctgaccgcgagtcgtgtaggaaaggcgcggaatatccaacagcgcgtgagaaagcgcattcagttgcgcctcgttgagatctttcgctttatgctgtccggttaatcctacctgccagaggatttcaacgcgcagataattccccagtcccgccagaaaggactgatccagcaacagcccggaaaattgtcggttgcgaaaacgcggcgacagcaatcgagctttaacctcttccggagtaagacgcgcgtccaacacatccggaccgactcgctgtaaaaaagggtgcgtcatgagctgctctgctgtcagcatttcgatatcagacgcgctataaagcagaataattttatccgccgtttgtagcctgacgcgtaatatacgcgtggtctgcggtatttcaccggtgtcgatcacccgccatacgccatagagttggttgtggctgtagagcgtcaggccatttgaaaagtgggtcaataacgcttttccccgcgtctctatccgggtaacaagttgaccggtaagctgcgattcatacggttttaactgtgcaaaggcaaaccagacatcggttaagggtttgcctttgattgccgcctccagattatccgccgcacgacgaatttccgggccttcaggcatgataatatcctttgttaacagttgattaatggactaccccgcctctgactgtctggaatgcacatcgaacgccataatgaatatccacagcggatggacaaacaggcggtggtatccagtgataataacattatcgcagcacgagaccacttccccgtcagggttaacgtgatcgcgccagggcataatcgactcagcccttgtcgggcgagcgcctaataatgattgtctgcctaccgaaattaaatgacgcttagttatattttgcccaaaatttttttctgttgagccttttaaagccttctttccaataactggcattcaactctttgatataattttctccgggaaaaagtttatcctttaaaggcagttttttggctagcacgattctttctgcgttagatcccgcggactctgaatgtgtgagggaagataaggcgtccagttgagcgcttgagggtctggctatcaattcaaaaaaaggttctgacaatacaacactactaagtgctgcataatttcctttttgtatgagcggtttgacgtactcaaaaaaagaaataatccctgattgcaatcttgccgctttttttaaatactcaatttcagaaccactgctatcttcacgtacaggaattattccattatccgtttttttatagccaattgttgacccagtattatcagccatagcgaactccattatttccacccctcctgataagaaaagatcacacttatcgtggggatggccatagttggttagataaccaaacatcttattataaatagatcggttatcattggcgccagcaaaagttgccaaataaaacccatgtatttgtttttctgcccattgcgcacctaaagaacgagcaaatactgattgaatattacccatccatcctacatcgataagtgctatatttttaaaaccttcacaggccgttttaaagtagatggaaagcagacacttgtttaagtaataaagacttacaaatagattcacccataatatctttagctttccaatgattagatatcccatgattatactctgaccaatcagcatggagagtatttatgccgagttttttagcattcagaatatcagcatgaacattatcgccaacatgtatccacgatgcaatatctacattttcatttttcttgactattgaaaataatttaccactatttttagagtaccgctcttcgccagatgaataaactggaatgttactgatatcatagccacatgatgttaacaactcctttaatattgctgatggaaggtacatatcactaattaaaatgactttgcaaccatcactaatagccttttcaaacaaacagcttccacgcgcatttttatataaaacaatcttctccatttgtatttccagatcgattatcttttttactgtcgctggtgaaagctgcggatgcttttttaaaatttcatcgtatatttcagatataagtatttccggctcgccgccaaaacgcctgaccctattctctctggcacttacttccgcctgaactcttatctctgggaaattatcaataataccaatctcgtacgctgatataaaaaatttctcagttgctaaagttgattgcattaatgaaaacaaatctctgggacggtaaatcctccggctaaccaatgtatcaaagatatcaaagcttacggtcttgtattttttaaagttcatatccatattttatttaatcttattttcaatataagaaattttatgaaaaagactattgttagcaatatttgaaagtaacacattgagcaatgatgagtcatcaatacttctcatcattttattttctgcaattttgcactctatatcaaataactcattgttaattacggtataattgccaaattcaaagtcatcattttctctgaaatgataaaatgccagtgcttcaggtaagatccaaacatcattttctgccagataatgaataaaaaaaggccagaaaaatgcaggagaggataatttatgactttcaatcacatcgataacagaatttttatcgaataaacacgaggatagtggaatagaattcctgtaataaataacatcaaaactaacagggccagcatttaaatagtggttccatggttgcgttgaatttataattattctattattttccgcaatctcagcaactttatttgtatggcatgctattgcatttacagatgaatacgttgactgtatattcgccaaaacactgagtagccttgacacatattcaggggcccaggaatcgtcatcatccataaagcataaataattagattcagacatcttaatagcattaaagatacagttttcgtcgtagataacactatatatatttgacagttctttcagataaaaatcatccacattgtgacatttcaattcttcctccatgcagaaaatgataatatttatttttttgaacgtctggtcattaatggattgcaaggcccgcattaatagacgagtacgcccaggtttatgtcggacaataactaaaagactcttttccatattctgatttcgcgttttacggtatatataaaaattaacaccctatgaatgaatgctgacattgggtaaggattataatattttattagactgacaccagataaggtgtagcaacagaaccatacctaagattatcatagtcatataattaaaaaatcggtataattctcatcaacaccacttacatcatgtttaatatttatcttcagattttttattgaattttttataccaaaagagctttgaggtaagatagggcaaactatttttcatctctttttttgcagatttaaaccgataaaaatttttgactgccgtaaacaaaccattaataataactttaaaaaactccatttttgagtgggtaagttttaataatttgccattttctatatttaaatgatagatagtaattctccggaatgaaaacttagtagggtgataatgacgataatcaaccaggattggttttttaattaaaaagaaagctggaattaagtgtccattaagggttatgcatctaaaaaatttgtagatggctttttctttaccagaacatgggtaatcaacacaaccattaacaatatcaataccttctacattgaatttttcattatgagttattgcattaattctttttcttatctccagaagatctacattatcttcccaaaactcccgtccagaaagacaatcgttatatgacataatcattgctctggcaagttcatagcggcatgaaaaactcgcaagaaagacttcccgcacaaagaaaacacttaacagtagtgcagcaaactttcttttactaattaatgcaggtacagcaacagtcctgaagttcaaatagctatttagaaccgatatttttctttcaaaatccatttgccacgaagccacaccattaagtgtgacaatattatgttttttatgcatatatccaaatagcaggtcatcaccacgaacaaagaaaggaaatgagtaatattcaatagcgttaatattaaaggcaaaaaaccaccatccaccgtagcctatttttctttcattatcaaaagtatctaaagaatctatttcccgagcatccagataatgtttatccgggtaatgtaaaaaatctctatgccatatggcaccagattcatgtatgattgccgggttatcttcaaaaagcatacagccagtaacaactgtatttttgtctttagccatcagtaaaaaagcatgagttcgacaaatcgattcaatttcacatgagccgtcgtcatccataaatatgacatgtttgacatcgttgattttccctgcctctatcaaacctctcataaacccgcctgacccaccgaggttttcattattgataactataatgccgtttcctgacgggtgattaatcgcctcgccattattaacgacaatcaatttaaaacgatctttaaattcgctctgggttaagagtgttttattaattaacagcttcttttctattataagttgttataactaaagccatagatgatttactaacatgatctttagtcagaaattaaaatccatttaaaacagagtcttcgtctgattgccactccacatagatatatccaaaatttatttttgatatatcaatctcaatctcaatctcaatctcaatctcatcactaatattacatgacgatttaaaatcaatttgctttaatactctaatgacaccattctctttatgccttacagttatagttccgcgaccaattatattaacccgcaaaaaaagtgatgttaaggttgtatattttttccatttcttaattgagaatgcattaaaaaaagtatcaaaatatgcaaccttatgacgcggaacaagtaagttacgtgaggtatagttatacttcccgccctgagttctgaaataaagctgctcttccgtgcatagatcaatgtttggtaaaattactttttgaagtaaaaaatacataacgaacctataaatttatattatctggggtaacgctattataaaatagtaaatttctcaccgcgtagtgatataaatactgcaataagaatattaaaatccacctttgctaactatctcactgtgctcaagcctgatgaacttattacatacagatttagccagttcatcatcatgagtggccattaccataatgcccgctttagagataaagctatttaatctcatctctgcttttcttttaaaatcactatcacccacgctcatccattcatccatcagtaaaatttcaggattaattgcagtagaaatagaaaaaccaagcctcagaaccataccactagaatacgttctaacggggattttaataaaatcacctaactcgctgaactcgatgacatcttctgtaatattttttatttcattttttgacagaccgagaaatagtcccctcagttttatattttccaggccggtaagctcaccatccattcccatcatgggatcaatgaggctggtgactcgaccaatacattcatacttccctgaagttggtttataggcccctgcaagtactctcagaagagttgttttgcccgaaccattgtgtccgataagcgcaagacggttaccttcggtaagcgtaaaatcaattttttttaatgcctctacttcaataatcccggtattcgatgagccaattcgtccacctgaagcagcctgtaaaaaagtttttttaaatgaacggtggctggagttaaatatagggagtattacgccaacgtttttgcaagagattttcattaattataaccagtatacgattcttgagcgatatttagtcaacactaaggttgagaccatcaacataataatagaggttattattgtgtaaaaccatatagttacatctggtacagttcccattaatggtttcctgagcatctccataaagtaataaaaaatattataatcaacaaattcctttcttccctttggtaattgttccgatgttcaaatgatgggagttataaaaaaacacaacgttactacactttgaacaaccggtcccatatcacgatatcttgtgcaaaaaatggcgagaatcatacctgtagaaattaatgagatggatgttattataattgcaggtataaaaaggagaatatcaagatttaccgatgtattggtaaaaaaaatcacgaaaggtataatgataaaattatgcaacataatcataaactgccgatagaaaacacgtaatatatataaatatagcggaaggtcagactgtttaataattgatgcggactcattaaatattccacatgattcattaatagttgctgatagaaaggcccaaaagatcatacctaaagtaagatgcatgataaaattttcggaaccagaactgaacagcgaaccgtaaagaggtcccattgctgatatggtgactcccatcgaaatcgttatccaaaaaggccctaacaccgatcgccggtatcgtcccaggacatcattccaacctagcgaaatccaaagttggtgcttggccagagcttctttcaaatcattcattgtttccgtgtcacctttacctgaagaacttattctttaacgatatgaaaatataacttatttattttctataatatttacatactatttatctaaacactgacctacttcataagcattttatggtgttagcaaccaatagtgtctttataaatttgcaatgtcttattaatgactaatatgctggaaaacaattcctttacacgttttcttccattcgcccccatctctaagcgaatctgtggattttttaacaaatactctaattctaccgctaactcctgagctgaattacttttcacgatcaacccattatagttatgaataattaagctatcacatccgccggtatcataagcaatacatgcacgtcctacagatgatgcctctaataaaagccgtggtactccttccggataaatagatggcaatgcaacgatattcgatttctgaataagctcatatacattcgaagagcgtcccagccagttaattagtccttcattatgccagtgatgaatgagctccaaagggatagcatctttatcgtcctcggccaatatacctgcaacatttaaaacaaaatgaatatttttttgtctgaggatcttttttgcttcaatgagatcgccaagacctttactccataacattcggcttgcaaaaaggactatcggtatctcatgttttttctctatagagaatttataaatatccgggttaattccagcaccttcgataacgatagttttatgataatcaatacctactaaacgcgatatttttcgtcgatctttatcatgttcaaaaataaaaacaccacgcttattaccggcaatatatttgtaaaccaaaacggttaacgcacgcaatattctcattggcacggtattatataaaaagattcgaccaagtccgacaaagctgataacaactggactattacttcttctggcgctaactccaccaatcaggcaaggtttgagcgtaatacaatgcaataagtcaggattaatctccttaataattttccgagcgttaaggaatgctctaaaaaaaacaaacatattaaatgactgagcaacaagagacacattgtgacaaataaaaccaagcgttttgaatttttttataatctcttcaccaataaaatgacttatgatatgaatttcataacccgcatcccttgccgctatcgcacgttctgtccagtgtaaatcaaagtaccagtctgaattcacaaaataacataaccttttcatctcttcgtcctgctaatgatatttcccactaatacctttaagtccatgaagtattccctgccagataaaatatagataacgaaatttcttacgctgccatggtaatatggcgagatatttagagaggcgtaatactatagaaagaacactgaatatcctgggaacgggtaaaagttttctcagcagcaacaaatttctacaaagataatatactttccattcggggcagatacaccttccatgaatagagatatcatgaataaatttaatttctggggagtaacgaattttctgcccggacaatactagcttataaccaaagaaaaaatcatcataataaaggaaaagttcatcatagatatcgttaagatggttattcaatacctttcgatcaataatcataccaacgaatgacacagtttgaacatcagtaacctgagttcttactggagaaaacctctctgggcgcatcgcataataaatagtctcaaacaccgtagatgggaccctaatgaaaggcaaattcatccgacaagaccgcccataggtgtcctgaactcgcgacgcaaatatacggtaacttgatgtatctaataacgagaaatgctttaaaatattaatttccgggtaagcatcatcatcataaaaaaatacccaatcggcattactatatgagcatatatattgactacctactttaaatccgccagcaccaccaagattatctttaagattaagtatcgtgatgccaggttcacttaatgaagaaagccattccctggtaccgtcgcttgagccattattaacgataacaatagaggaaaaacccgccttaacagtctctcgcacacttttttttaatttttcaagacgattaaaagttacgattagcgctgtacacttcatcaaacggtaactgtaaaagctggcatttctttttgttcatatagcgacgttaagtatacgtccgccgtctgtaatgcttcagctatcgtgatgtccatatcgagataacgataagtgccaagacgaccaatgaaagtaatattttttcttttttagcccgcgacagatatttattcagtaaatccattttatctgccctgcgaacaggatagtagggtatatcaccagcttcacattcccgactatattcttgataacatattgaagcttcatgtctctcccacggagaaaaatatttgtgctcagtaatccgagtataaggagtatctattgaacaataattcattactgcgcatccttgataatcactctggcaaattatttttttaaagtctaatgtacgatattccagtcggccatattgacaggagtaaaaggcatccagcgcgccactgaaaaaaacatgatcataatttgtccgcatttcttgagtgaaggagcgacatagttcaacagcgatattttcgtgttcgacaatggacttgaccatttgtgtataaccaaattttggtattccctgaaacttatgattgaaatagttatcatcataattaaaacgaacagggatacgtttcaatacagaagcgggtaacgcggaaggatgaagcccccattgtttaatggtataacctttaaaaaaggcttcatataactctttaccaatgaaacgcaaggcctgttgctcaaaattttgtggttccagaatggtgctatcacatttttgaagcagtaatttcctggcgtcatcaggtgagcaggcgacaccaaaaaattgattgatggtatgaagattgataggtagagaaaatacctgaccatttactgtggccttaaccttattgatataaggcatcatctcagcgtatttatttacataattccatacagtttcattatcagtatgaaaaatatgaggaccataaacgtacaccataatacccgtgtgctcatctcgggcatcataagcgttactaccgatatgcgaacgttgatcaataatattgactacatgtccctgctcggctaactggcgtgctattactgcgcctgaaaggcccgcacctacaattagtatctttttacgttgcattatttttgtcactctgttcgcagacacagataatattagatagtttatccagaaccattttcatttatatcagaagagtaaagtgaaatttactcaacgcatccagataattccacgctaccgccacagcgcgtaaaccctcgcactgattacagattcattaatgttacacgttatgcggtatttccggacaacgatgattgccatatttattttgtgaagataactcattcagaacgcaacattatgggtctgaataccgcgcggcatgatgtaaatatgctgtcagcataaatccggtgcgttaccggccccagtttttaccaacccactctgttgactgatgtccggaccgacgtccggtatccttattcttaccgcatcagatagcggtactcctgtcgggatatcccagcgttgtttcagcgtctgctccgcgagccagacctgcctcacgccggttcccagcatacgggccgtcatttccgggctacagcctgacaacagtaatcccagcacccgccgtccctgttttggcagacgctctgacagtaacctgaccagcgtgcggctgtttatctccatcaccagctccggcacgctcaacgcgcttttcatctcctcctcgtaaggcgatgtctgtagtgatgaccatatggcaagctcagccattctggccagaacccttaccgacatggcgcgtttaatcagcctcagatggcggaagtaaccttccacgctgacgtcaaccggtaaaaacgcgttactgctgcaaaaaaccactgtccgcggataacgcagaaaaacctgttgccacagcagaagctgggttgatggccgtccggcggatatcaccatcgcgccgggccaccgacgcaaccgatccagcagcccttctggtgtcctgagacgaacgcagtcctccacgcaaaggccgccggtatccggaaactgcgtaggattttcgcctgactgacaaaacataatcagccggagaggcggcagtactctggttaacgtctgcatatcagtacgtcagaacctggtacaggctgaacaacgctgcgacggtggagaccgccagcaggagcaaaaatatttttgcgcccatactgtaccggcacttactggtccccccccttccggtggacatttccgcatattcttgcgtcatcagattgttctcctctggccattgccgacccggcactgcgccagcaacggcagcttcgtgttgtggaaacaacatgtccgcaccctttcgtggaccgggagccattccatgtctgtatgaaaaatgacgtctggccccatctaaacactgctctctgacaccctgtccggttctgcttttcggctgcacaggccgtcagtccccctggtagtacatgctcctgccgtagggtaattctgccctgtgcggagtacaaaatgacaaatagaaaatacagtaatctattgatttatatgttgattatgtaaatcagctttccctgaacagacttctctgtgatttaacaatatgaatcagaacgtacggttatactcgacgtttttttcgccatattccatgaaaacgcccggcgttacttgcggtgtatcttacggtgtgctggatattcctgtgccccagatagtcctgtatgagtcgtgtatcaatccctttatcagcaagggcgtagccgcaggcatgtcgcagcatatgaggatgtggcgctatcgttaattcggccaaccgccctgcctcacgaagtatgtaaaaaaattgttgcctgctgagcggatgccgtcgtagcgacaggaacagccagtctccgtcagcccctttctcaagatacttcctggccctgagccagcttttcagtacgttatactcatcgggaaggagggggtgacacgttgaaaagccatttttgaggcgccggatataaagctgtcttcctgcaagatcaatatccgacaagcgcagccccagcagctcactggcccggaagccgtgaataaacgccatcaggattaagcagcggtttctttccgggaagggcattctgtcggtcgctgacagcagtttttcaatctcttcttgcgtaagatattttcttttcacaaaacaaatccatcataacaaaatgagtaatatactaaaaaatcactgatcagatgagtttaattttcgctaaaaaagttgctatgcgtaaacagcttaaaatccatatagctggcaatctggcacgctatccatgacgtgatagtgaaacagcgaatcaatctggcttcaatctcctgataagttgtcatgacgaggaatataaatgctaaaaatgaggctatcgtgaggtaaatcaatcagaaaggggtaatagagagtcaggtagtttacccgccccggaggtttgattagatggcgatagctaacaatatcatagtgattttcaaaaactctgctgctaacagcaataagctcatcatactggctattacagcatcacttggttatttttaaaataatatattataaggggatttatatagtattgaataaatccctcttcctgacattaagagaacagaacacgataatttttagcagccgtaatataatagcttcaatcgtcgggctctcaggcaataacgtgtacattacgcgcattgaacgcggcgcgtagcctgcgtgcgaatgcaagcgcatactcgccgtcgccatgaatgcacaccgtttgcgccgtgacagtcgtccacacgccagtaacgcttttcactctcccggcttgtaccatatccagcgtttgcgccagcgcctgctcttcgtcgtgaatcagcgcgccaggttgcatgcgcggcaccaggctaccgtcggcctgatagccgcgatcggcaaacacctcctgccgcgtcaccaggcgatggcgttcaccggcccggatcagctcacttcccgccagtccaaccagtatcagtgacggatcatagtcgtgtaccgctttcgcaatcgcctgtgccagatggggatctttcgccgcctggttatagagcataccgtgcggtttgacatggcgcatcacgccgccttgcgcctggacaatcgcccccagcgcgccgatttggtacagcgtctgggcgtataccgtttccggcggcaaaaccatcgccgtccgcccaaaattatcccgatccggaaagctgggatgcgcgccgatcgccacgccgtttttcagcgcctcgcgcacgcaggtcagcatggtttgcgcatcaccggcgtgaaaaccacaggcgatattagcggaggagaccagcgttaataattcgctgtcgctggcgcaaccttcgcccaaatccgcatttaaatcaatgttcatgctgaagtcgccaggtaagctgttccagatagcgccgacgctcgcggcgcgcgttgagcgcctcctccagcgaacattgcacaaaatggatcggttgttctagcgggatctgcgccagatggtacatatctgcctcgatgatgcaggcaatgcgcggatagccgccagttgtctgggcatcattcattaacacaataggttggccgttgtaaggcacctgcacgacaccgggcagcaaaccgtgcgacagcagttcgcgatccgttgtccgcgttaacgattgtccctgcaaacgatagcccatgcgattactttgcggactgagctgccacggcgaacgccagaacgcttcttgcgaggcgcgatcgaactcacggtattccggccccggtagcgcacggatgcgattcccccacagtaactgcttcacgccctgcggcccgctaagctgtcgcgatggtttacccgtcgccagccgatcgccatcttttagcagccgtccttccagcccaccgatgccggacttcagatcggtactacacgatcccatcacctccggcacagcaataccgcccgccaccgccagatagctacgcatcccgtgaagcggtcgatgcagcgtaagacgctgacccgcttttaccggcaatcgccagccggtccagaccggttgatcatccaactgcgcctcgcagcctgcgccggtaagagcgaaccaggtctcattttcaaattcgacaaccagttgaccgagagtgatttccagcgccggggcattcgcatcgttcccgaccaggagattagcggtctgaaaggcgggtttatccagcgcaccgcagtgactcagccccgactgacgaaagccgtgacgcccgctatcctgcacggaggtgtaaatccccgcgcgaataatattcagcatattccctccttttgcggcacaaagcgtacgctatcgccagggcgtagcagaaccggggtctcccgcatcggatcgaataacttcaacggcgtgaggccgatcagctgccagccgcccggcgtggataatggataaatccccgtctgcgcgccgccgatgccgacagaaccggccggaacctgcaggcgcggctctgcgcgtctgggcatatggagcggttctggtaaattcccaagatagggaaagccgggctgaaagcctaaaaaccagacgacatactcaacggaggcatgtagctccacgacctgcttttcactcaaaccgctgtgccgtgccaccgccgccagatccggcccgcctgcgccgccatagatcaccgggatctcaaccgaacgcgagtccggttccagcgcctcgctctcttcccaccagcgctgcagacgctcaatcgcatccagcgccagagtttgcggttcccgcaagatcacggtgatattgttcatcccgggaatggcttccaccacgttcggcatatcgaccagacgctgcgtcagacgccagatgcgtttctggctcgccagcgtaatcggcggttcaagttccaggacgaccgccgtttcgcctaacagataacaacgcgctcgctgcactttattacctctcagttatgccgggttagggatatcaataaacgtcacatccaacgccgtgttttcgttcaaccattcgctcagggcgcgaataccgccgcgttcagtggcatggtgcccggcggcataaaaatgcagcccctgttcgcgtgcggaatgaatggtctgttcagacacctcgccggtaataaaagcatccacgccgaagcgggcggcgctatcaataaaactttgtccgccgccggtacaccaggcgacacgctgcacattctctggcccggtatcgccgcaccatagcggtttacgccccagacgcgcttcaatccatgaggccagttccagccccggcaccggcattgagagctctccccacggcaccagcggctcaatttctcctttcacggtaatgcccaatagcgccgccaactgcgcattgttgcccagctcagggtgcgcatccagcggcagatgccaaccgtaaaggttaatatcatttgccagtaacgtttttaagcgacggcgtttcatgccgcgaataaccggagactcgcctttccagaagtaaccatgatgaacaatgaccgcatcggcctgcaaacgcaccgcctcatcgagcagcgcctgacttgcggtcacgccggtaacgattttctgtaccgtctcttttccttcgacctgtaaaccattcggcgcataatcgcttattgccgcactgttcagcttgtcgttaatcagttgttccagctcggtgtttttcatcatcgctccctttaacccacgttctactttcccgttacgggttcagtctccgttaacatagcctcccgttagccgttcgtcgataaacatttgtttgacacatcaagaaacaatcacccccgggtttggcgcaaattacttagcaaaacacgatcggtttcatgtatatttatgcaatcagaacgcatattgcagaaaaaatcagttctgtatcatgttggtaactttaaggaaacacggcgatacggcaggcttaataagcccacaaagaaaggcattatctgagaatgccgcgttcttgccgcagcgtctctatcccggaaatacgatgaataaacaagcatctcaaccccgcgctatttactacgttgtcgccctgcaaatttgggagtacttcagcttttatggtatgcgcgccctactgattctttatctcaccaatcagctaaaatacgacgataaccacgcctatgagttattcagcgcttattgttcgctggtctacgtaacgccaattctcggcggctatctggcggataaggtgcttggcaaccgaatggcagtcatgctgggcgcatttttaatggctataggtcatttagtgctgggcgccagtgagatcgcgccgacattcctttatctgtcgctggcgatcattgtctgcggctacggcctgtttaaatcgaatattagctgcctgctgggcgaactgtaccagccggaagatccgcgccgcgacggcgggttctcgctgctttacgcagcgggcaatattggttcgatcgtggcgcctatcgcctgcggctatgtgcaagaggagtacagttgggcgatgggctttgcgctcgccgccattggtatgctggcggggctggtgatcttcctgtgtggaaatcgtcatttcacccacactaccggcgtgaataaagccgtgttgtgcgccagaaactacctgctgccgaactggggctggctgttaattctgctggtagcggcgccgttgctgattaccgttctgttctggaaagaatggtctgtctatgccttaatcgtggcgaccgcgatcggcctggtcgtgctggcaaaaatttatcgtcaggcgcaaacggccaaacaacgcaaagaactggggctgattgtcaccctgaccctgttcagtatgctgttctgggcgtttgcccagcagggcggcagttctatcagcctgtatatcgaccgctttgtgaaccgcgatattctgggctattccgttcctaccgccatgttccagtcggtgaacgcctttgccgtgatgctgtgtggggtcgtcctggcctggctggttaaagagagcgtaagcggtaatcgcaccgtgcgtatctggggcaaattcgcgctgggtctcggtctgatgagcgccggattctgtattctgaccctgagcgcacgctggtccgccgcttacggacactcttcaatgccgctaatggtgctgggactggcggtgatgggctttgccgagctgtttatcgacccggtcgccatgtcgcaaattacgcgcattgatatccccggcgtcaccggcgtattaaccggaatttatatgctgctgtccggcgcgatagctaactatctggcaggcgtcatcgctgaccagacctcgcaaagcgccttcgacgccagcggcgcggttaattacgccatcaacgcctatgtggatgtttttgaacagatcacctggggcgcgttagcctgcgtaggggttgtcctgctgatttggctgtatcagtccttcaaattcaaaagccgcgcgctggccgtcgaatcctgatagcagaaggcccggtagtttgcgctaccgggcctgtatcacgccccttttctcgccgcctcataggcggaaagcgttgcgattctcgcctgtttgtgctccacaataggccgaggataatcaagtacgactcccgctttttccgcccaccgccacggctcgtgaatcgcttttccaggtatatcgcgtaatgccggtagccactggcggataaattcgccgtcgcgatcgaacctctctctctgagtcgtgggattaaaaatacgaaaataaggcgcggcatcggtaccggttgaagcggcccactgccagccgccattattggcggcaagatcgccgtcaataagctgcgacatgaaatagcgctcccccaaccgccagtcaattagcagatcttttaccagaaagctggcggtaatcatgcgtaaacggttatgcatccagcccgtcgcgttaagctggcgcatcgccgcatcgacaatgggataaccggtttcgcctttctgccatgcctgaaaatagtgcgggttctcctgccacgcgacgcgttttgtccagcggataaacggctggtgtttgcataatgccggataccaggtcattaaatgacggtaaaattcccgccagatgagctcattcaaccagacgcttcccggcccgccgtccagcgcctgcggctgctccgccagtaatcggtgcaggcactgtcgcggcgacaggccacccgtcgccaggctggcggaaagccgactggtgccgtcaaccgcagggaaatcgcgccgtgacgcatactcgtctgcgccctgcgagcaaaaatgacgtagctgcgcgatgaccgcgttttcttccaccgggaaaagcgcggcgtcaaacgcctgttgcgggtagttaagcgagactggcgttaagggtatagaaagcgcgccgctcacccggatcttcggggccggaacgcacggcgggatatcctcttttagccgtttcaaccaggcgtttttaaacggcgtaaaaactttatacatttcatgattgccggtcatcaccgcgccgggcgccagaatcacgctatcgtcaaagccttcgcagatgacagatggcagcgttttttccaccgccgcatcacgctgacgctcgttaaactcatactgatagttataaaacagatggctgacgtcatgctgccggcaaacgtttttaaccgtctcaatactggcgttaaaatccgccacttcatgaaacagcagcggaatccctttctctgcaagggccgtctgtagcgcattgagctgcgcgctgatgaatgccgcctgccgcggcgccatatcatgggcctgccactgggcgggggtggaaatataaagcgccagcacccgcgcggatgcatcgcggcaggcggcggccagcgcaaggttatcctgtaaacgcagatcgcgcctgaaccagactaaatgggtgggcatacaactcctgaaagatgaaacgtcacggcgaatagcgttaaacagtgtagaccctggcgcataaaaaaaccgccagcgtggcggctgacggtttttcaggctggtcgcgattaataaaagtcgcaggtggctttttcagcctgcgccatccataccggtttatcactggttttcgaccagacacggtgcagataactataaaaacgcgcgcggtctttccagaagagcatcaccggcaacgccagcacgcctgcggtcaccgcgaaagcacgacgtgcaaaaatgacatgcgctggatagtctttatagtgttccatacgtttcccccctttataccgacgctatccgccccggtatagattgaatcggtgaatagcaccgaaaaattgaacctcgttacctgattaaaatagtaccgctttcggtgtaatttcactactcatccgaccacttattttcacgcttttccagcagatttacattcaaagcgtaaattagttacaaaaaggttaaattaatactaatcattagttaaataatggtctttgccatttttatactttttttacactccgcccgccaatttttgcgaaatctttgcagccaaaaaattacctttctcaggagtaaaacaatgccactggaggtgctctgtgagtgcaggcgtgataaccggcatcgtgctggttttcttacttttaggttatctggtctatgccctgattaatgcggaggcgttctgatggccgcgcaaggatttttactgatcgccagttttttactgattttattggtactggcgaaaccgttgggttcgggcctggcaaggctcatcgccgccgttccgttgccgggcgtggctggcgttgagcgtatcctctggcggactcttggcattaccgaccacgaaatgaactggcgtcagtatttactggcgctactgacgctcaatctgctgggactgggcatcctgttttgcctgctattctggcaggagtggctgcccttaaatccgcagcggctaccggggctgtcctgggatctggcgctgaataccgccgtcagctttgtcaccaataccaactggcaagcctacagcggcgaaagcacgctgagctactttagccagatggcggggctgacggtgcaaaatttcctgtcggcggcgaccgggattgcggtggtttttgcacttatccgcgcctttacgcgccagaatgtgcacacgctgggtaatgcctggcaggatctggtacgcattacgctatggatattatttcctgtcgcgttaattatcgcgctgttttttatccaacagggcgtaccgcaaaacctgtcggcttatcagcccatcaccactcttgaaggcgctaaacaactcttgccgatggggccggttgcttcgcaggaggcgatcaaaatgcttggcaccaacggcggaggtttctttaacgccaactcttcgcatccgttcgaaaatcccaccgcgctcactaatctggcgcagatgctggcgatatttttgattccagccgcgctctgtttcgcctttggcgaagcggcgggcgatcgccgtcagggacgcgccctactgtgggcaatgtcattcatttttgtggtctgcgtagcggtagtgatgtgggcggaagttcagggaaatccacatctgttggcggcaggcgcggacagtagcgtcaacatggaaggtaaagaggcacgctttggcgtgctggccagcagcctgtttgccgtcgtcacgaccgcggcgtcctgcggggcggtaaatgccatgcacgactcgtttaccgctctgggcggtatggtgccgatgtggctgatgcaaattggcgaagtggtctttggcggcgtcggttcagggctgtacggcatgttgctgtttgtcctgttggcggtgtttatcgcggggctgatgatcggtcgcacgccggagtatctggggaaaaaaatcgacgtgcgcgaaatgaaaatgaccgcgctggcgattctggtcacgccgatgctggtcttgttgggttcggcgctggcgatgatgacggatgccggacgcagcgcaatgctgaaccctggcccgcacggttttagcgaagtgctatatgccgtctcctctgccgccaacaacaacggtagcgcctttgcaggtctgagcgctaactcgcctttctggaactgtttgctggcgttctgcatgttcgtcggacgtttcggcgtgattattcctgtcatggccatcgccggatcgctggtcagtaaaaaagtacagccggccagtcagggaacgctggcgacccacggcgcgctatttattggactgctcattggcacggtactgctggtcggcgcgctgacgtttattcctgccctggcgcttgacccggtagcggaacatttctctttaccttgagcgatgcggagtacattgatatgagtcgcaagcaactggcgctgtttgaacctgttttactcgtacaggcgctaacggatgccgtaaaaaaattaagcccacgcgcccagtggcgtaacccggtgatgtttgtggtctgggccggcagcgtgctagccactctgttaacgctcgctatggtaacaggacaaatagcgggaagcgccttgtttacaggggtgatcagcctgtggttatggttcaccgtactgttcgccaattttgccgaagcactggcggaaggccgcagcaaagcccaggcaaacagtctgaaaggggtgaaaaagaccgcgttcgctcgccgtctgcgcgccccgcgccatgatgcgcaggccgataacgtgcccgccgctgaactgcggaaaggcgacattgtcctggtcaaagcgggcgatattattccctgcgacggcgaggtcatcgaaggcggcgcctcggtggatgaaagtgcgattaccggcgaatccgcgcccgtgatccgcgagtccggcggcgatttcgcctctgtcaccggcggccgcgccgtagaagccgcgggcgatgtcgacgtgttactgctggataaaaccggcactatcacgctcggcaaccgccaggcgtccgattttatacccgcccgaggggtggacgaacgcacgctggctgacgccgcgcagctcgcttcgctggccgacgaaacgccggaaggccgcagcattgtgatcctcgccaaacagcgctttaacctgcgtgaacgcgatgtgcagtcgcttcatgccacctttgttccgtttaccgcgcaaagccgcatgagcgggattaatatcgataaccggatgatccgtaaaggctcggtggacgcgattcggcgtcatgtcgagagcaatggcggccattttcccgccgatgtcgagcaaaacgtcgagaacgtggcgcgtctgggcgcgacgccgctggtggtcgtggaaggcgcgcgcgtactgggtgttatcgccctcaaggatatcgttaaaggcggcattaaagaacgtttcgcccagctacgaaagatgggcattaaaacggtgatgatcactggcgataaccgcctgacggcggcagcgattgccgccgaagccggtgtggacgattttcttgccgaagccacgccggaagccaagctggcgttgatccgtcaatatcaggcggaaggacggctggtcgccatgaccggcgacggcactaacgatgccccggcgctggcgcaggctgacgtcgcggtggcgatgaactccggcacccaggcggcgaaagaagccggtaatatggtggatctggactctaacccgaccaagttgattgaagtggtgcatatcggtaagcagatgctgatgacgcgcggctcgctcaccaccttcagtatcgcgaatgatgtagcgaaatatttcgccattattcccgccgcgtttgccgctacctatccgcagctaaacgcgctcaacgtgatggggctgcattcgccgaactccgccattctgagcgcggtgatctttaacgccctgattatcatatttctgatcccgctggcattaaaaggcgtgagttataagccgctttccgcatcggccatgctgcgccgtaatttatggatctatggtctgggtggtctggtggtgccgtttattggcatcaaagtgattgatgtgctgctgaccctgctggatctggcgtgaggtgtatgatgatcggtttacgtcctgctttttcgacaatgttatttctgctgttattgaccggcggcgtgtatccgcttctgaccacggcgctggggcagtggtggtttccctggcaggctaatggctcgctgattcataaagacaatctgatacgcggctcagcgcttatcggacaatcgtttaccgccgcgggctattttcatggccggccctccgccaccgccgatacgccttataatccactggcgtcgggcggaagcaacctggccgccagcaatcccgaactggatgcgcaaattcaggcccgcgtcgccgcgctacgcgccgctaacccccaggcgagttccgcggttccggttgagctgacgacggcgtcggcaagcgggctggataataatctgacgcccggcgccgcggcatggcaaatcccccgcgtggcggcggctcgccagcttcccgttgaacaggtcgcgcaactggttgcagaatatacgcacaggccgctggcgagctttcttgggcaaccagtggtgaatattgttgagcttaatctggcgctggatgcgctacagggacacagagcgaaatgaacgacgaacccttgcgtcctgatccggatcgcttgttggaacaaacgcccccgccccaccgggggaagttaaaaattttcttcggcgcctgcgcaggcgtcggaaaaacctgggcgatgctggcgcaagcgcagcggctgcgagcgcaggggctggatgtggtgatcggcgtggtagagacgcacggccgtaaagagaccgccgcgctacttgacgggctgaccattctgccgccaaaacgtcactcgcaccgggggcggcaaattcgcgaatttgacctggatgccgccctcgcccggcgtccggcgctgattttaatggatgagctggcgcacagtaacgcgcctggctcacgccatcctaagcgctggcaggatattgaagagctgctggaagcgggaatcgacgttttcaccaccgtgaacgtacaacatctggaaagtctgaatgatgtggtgagcggcgtcacggggattcaggtgcgcgagaccgtccccgatcccttttttgatgccgctgatgaagtcgtactggtcgatctgccgcccgacgatctgcgccaacggctcaacgaaggtaaagtgtatatcgccggtcaggcggaacgcgctattgaacattttttccgcaagggcaatctgatcgccctccgcgagctggcgctacgccggacagccgatcgcgtggacgatcagatgcgcgcctggcgcgcgcatccgggcgaagaaaaagtatggcatacccgcgatgcgattttactgtgtatcgggcataacactggcagcgaaaaactggtgcgtaccgcggcgcgtctggcctcccggctcggcagcgtctggcacgccgtctatgtcgaaacgccaacgttacaccgcttaccggaaaaacaacggcgggctattttaagcgcgctgcgcctggcgcaggagcttggcgcggaaaccgccaccctgtccgatcccgccgaagagaaagcggtcgtgcgctatgcccgcgagcataatctggggaaaatcgtcatgggccgcccggcgtcgcgacgctggtggcgacgtgacgctttcgccgaccgtcttgccaggcgcgcgccggatctcgatcaggtaatcgtcgcgctggaagagccgccagcgcgcgcgttggcgcaaacgcctgataaccgaccttttaaagagaaatggcgtggacagattcagggctgtctggtcgccgtggcgctttgcgccataaccacgtttatcgctatgcagtggcttgtcaccttcgacgccgccaatctggtgatgctctatttgctgggcgtagtggtgattgcgctgctttacggacgctggccgtcggtggtggcgacggtgattaacgtggcgagtttcgatctcttttttatcgcaccacgcggtacgctcgccgtttcggacgtgcagtatttgctgacctttgccgtgatgctgacggttggtctggtgattggcaatcttactgccggggtgcgctatcaggcgcgcgtcgcccgttatcgggaacagcgtacccgccatttatatgaaatgtctaaagcgctggccgtcgggcgtagcgaacatgatatcgccgcgaccagcgagcggtttatcgcctcgacgtttcaggcgcgcagccaaattttattacctgatactaacggtaagttgctgcctctcacccaccagcaaggcatgacgccgtgggacgacgcaattgcgcgctggagttttgataaaggccagcctgccggcgcaggcaccgatacccttcctggcgtgccttatcaaatcctgccgctgaaaagcgccgataaaacgtacggtctggctatcgtcgaaccgggtaatttgcgtcagttaatggtgccggagcagcaacgcctgctggaaacattcactctgcttgtcgccaacgcgctggaacgactgacgctgaccgccagcgaagaacaggcgcgtctcgccagcgagcgcgaaagtattcgcaacgctctgctggcggctctgtcgcatgatttacgcacgccgctgacggtattgttcggccaggcggaaattttgacgctggatttagccagcgcaggatcgccccacgcgcgtcaggccagtgaaatccgccagcatattctcaacaccacccggctggtgaataatttgctggatatggcgcgtattcagtccggcgggtttaatcttaaaaaagagtggctgacgctggaagaggtcgtcggtagcgcgttacagatgttagagccgggtttattgcatccgattacattgtcgctgccgcaacagttaacgcttatccatgtcgatggccccttatttgagcgtgtcctgatcaacttgctggaaaacgccgttaagtacgccgggccgcaggccagtatcggcattgatgctgcggttaaggacaatcgtttacaactggatgtctgggataatgggccgggtattcctgcggggcaagaacagaagattttcgataagttcgcccgcggcaacaaagagtccgccgtccccggcgtggggctggggctggcgatttgccatgctatcgtagaggtacacggcggcacgcttaccgcctataatcgaccgcagggcggcgcctgtttccgtgtgacgctgccgcaaggaaagccacctgaacttgacgattttcatgaggatatgtgacaaacgttctgattgttgaagatgaacaggccatccgccgctttctgcgcgccgcgctggaaggcgacggcctgcgcgtgtatgaagctgaaacattacaacgtggtttactggaagccgccacgcgaaagcccgatctgattattctcgatctcggcctgccggacggcgacggaatcgattttattcgcgacctgcgtcagtggagcgcaataccggtgattgtcctttccgcccgcagcgaagaaagcgataagattgccgcgcttgacgccggagctgatgattacctgagcaagccattcggcattggcgagttgcaggcgcgtttgcgtgtcgcgctgcgacggcacgccgccagcccttgcgccgatccgatcgtccgcttttccggcgtgacggtcgatctcgccgcacggttgatccaccgtggcgacgaagaaatccatctgacgccgattgagttccgcctgctggcggtattactcaataatgccggcaaggtattaacccaacggcagttattaaaccaggtctggggccctaacgccgtggagcatagccactatttgcgcatctatatgggacatttacgccagaaactggaacaagatcccacccgcccacgccattttattatcgaaaccggaattggctatcgctttatgccgtgaatagctattcattatttttaaataacttttaatttttatgtcatttattttcggcgtcgcgaataattattttcgcggcgatattatattttatggaggatataaaaaacatataattaacatttaagaaacaatccgttatttcacagcacgatatgcataatcgccgactaattatttttcaaatgatcgttttttgttgatctggttcacagattgctggcgctccctggataaaatatccatgctttcaataaatcaatgaaaggacctcaaaatggaaaataataatcgttttatgccccatataaggcggacaacgcatattatgatgtttgcccaccgtaatagtttcgactttcatttctttaatgcccggtattttttctgctacgggtacttcagcatacaggtctttccgacccttatgtcattcaggtctattgcctaaataactcgaattgttaaaagcgacagtacggtaattcctttacgcccagccagctaactatgtggtttgacagaagaaattccgactcagcgcaattttagttatcgcggtttctgcctgtatatcgtagtactcaactccttaaatcctgaatttcctgcaaccggacgggttgggatttattacatctaaaataaagctaatttactgatttttttatcagcgggatagctttgattttttccggaagaatcagtttctcatgcgagaaattgagggcctgctattacctgaaataaagagatgaaaaatgtcagaattaaaaattgccgttagccgtcattgcccggattgtttttctacacaccgtaatattgtaaatgttgatgagagtcgtttcatcgacgtggctgcatccgtgttatccatcgacgacattgaacacggaaaactcgatgaaatcgacgcaacgggttacggtattcccgtgtttgtcgcgactcatgacgaaggacgcgtaccgcctgagtatttgccgcgtatctctggtgtattcgaatataatgaatcccgtactgccttctatggtcgccagttggaaaccgcagcaagccactacgaaacgcagttacgtccgccgtttttccgcgcgctggtggattatgtcaaccagggcaacagcgcatttgactgcccggggcatcagggcggcgaaagtctttaacgccgataagacctactttgtgctgaacgggacctcctcctctaacaaagtcgtactcaacgcgctgttaacgccgggcgatctggtactgtttgaccataacaaccacaaatctaaccaccacggcgcattattgcaggcgggcgcaacgccagtttatctggaaaccgcgcgtaaccgtatggttttatcggcgggatcgacgctcactgcttcgaagaagattacctgcgcgagctgattagcgaagtcgcgccgcagcgtgcccacgaagcacgtccattccgtctggccgtcatccagttaggcacctacgacggtacttaggcacctacgacggtaccatttataacgcctgtcaggtcgtcgataaaattggtcatctgtgcgactacatcctgtttgactccgcctgggtcggctatgaacaatttattccgatgatggccgattgttcgccgctgctgctggaactgaacgaaaacgatccgggtattctggtgacgcagtccgttcacaaacaacaagccggtttctcccagacctcgcagatccataaaaaagatagccatatcaaagggcaatcgcgctacgttccgcataagcgcatgaacaacgcctttatgatgcacgcctccaccagcccgttctatccgctgttcgccgcgctggacgttaacgccaaaatgcacgaaggcgtcagcggtcgcaatatgtggatggattgcgtagttaacggcatcgatgcccgtaaattgatcctcgaaaactgtcaccacatccgtccgttcgtaccggaactgattgatggtaagccgtggcagtcatacccaacgtcagagatcgccagcgatctgcgcttcttccacttcgttccgggagaacactggcatgcgtttgaaggctatgccgaacatcagtactttgtcgacccttgcaaactgctgctcaccacaccgggcattaatgcagcgagcggcgaatatgaagactttggcgttcctgccacgatcctcgccaacttcctgcgcgagaacggcgttgtgccggaaaaatgcgacctcaactccattctgttcctgctgacgccggcagaagacatggcgaagttacaacagcttgtcgctctgctggctcgtttcgaaaaactgctggaagctgatgcgccgttagcggaagtattaccgtccatctacaaacagcatgaagcgcgttatgccggctataccctgcgtcagctttgccaggagatgcacgatctctatgcgcggcacaacgtgaaacagctgcaaaaagagatgttccgtaaatcgcatttcccgaaagtcagtatgaacccgcaagaggccaactatgcctatctgcgcggcgaggtcgaactggttcgcctgccggaagcggaaggtcgtatcgcggctgaaggcgctctgccttacccgccgggagtgctgtgtgtagttccgggtgaaatctggggcggttctgtcctgcgttacttcagcgccctggaagaagggatcaacctgctgccgggctttgcgcctgaactgcagggcgtttatatcgaagaacacgacggccgtaagcaggtctggtgctacgtcattaaacctcgtgacgcgcagcgctccctgctgaaggaggaaaaattatgagtaaacctaaatccaataaaatgggtgtcgtgcagctcacaattctgactatggtcaacatgatgggctccgggatcatcatgctaccgaccaaactgtctgaagtcggcacgatatccattatctcctggctggtcaccgccgtcggctcgatggcgctggcctgggcgtttgcgaaatgcggtatgtttagccgtaaatccggcggcatgggcggttacgccgaatatgccttcggtaaatccggcaactttatggcgaactatacctacggcgtctcgctgctgatcgccaacgtggctatcgccatctccgctgtcggctatggtaccgaactgttcggcgccgcgctgacgccgctccagatcggtctggcgactatcgccgtattgtgggtttgtaccatcgcaaactttggcggcgcgcgtattaccggacagatcagtagcgttaccgtttggggcgtcatcattccggttgtcggcctgtgcatcattggctggttctggtttagccccagcatgtacgtagcgtcatggaacccgcaccatgttccgttctttagcgcggtcggctcttccatcgccatgacgttgtgggcatttcttggactggaatccgcctgcgctaacgcagacgtggtcgagaatccggaaaagaacgtccccatcgcggtactgggcggtacgctgggcgcggcggtcatctatatcgtttcgactaacgtgattgccgggattgtgccgaacatggatctggcgaactccacggcgccgtttggtctggcgtttgcacagatgttcacgcctgcggtaggtaaagtgatcatggcgctgatggtaatgtcctgctgcggctcgctgctgggctggcagttcactatcgcccaggtctttaaatcctccgctgacgaaggctatttcccgaaagtcttctctcgtgtaacgaaagtcgacgcgccggtacaggggatgctgattattgtgattattcagactggcctgtcgctgatgaccattagcccgtcgctgaatagtcagtttaacgtcctggttaacctggcggtggtgacgaacattattccgtatattctgtcgatggccgcgctggttatcattcagaaaatggcgaatgtgccatcatcaaaagcgaaagtcgctaacttcgtggccttcgttggcgccatgtatagcttctacgcgctatattcctccggtgaagaagccatgctgtacggctcaattgtgaccttcctcggctggacgttatacggcctggtctcaccgcgttttgaattgaaaaataaacacggctgatggcgcgcccgggctgcggtaacgatagcccgggcattttcactctttgaataagataatagaaatgagtaatccagaacgggaagtcactgatatagcagaaatactggctattctcagtaaacacgaagtgtgtcggatagggtttaacgacaatctctgtccgtatgttgtccccgtaaattttggctacgagtatcagaacggacgctggatattttattttcacggcgcacgcaccgggaaaaagatgcgtctgttacgtaagaacccggcagtatgcattgaaatggacggcgaccatgcattactacgtgccgatgacccctgtgattatagctacgcctacaccagcgttttcgccaccggactggcatcgatattgcaaacgcgcgaggagatgcgccacggcctggacgtcattatgcgccagaccgatccgggaaaaaccttcagttatcgggaagatatgatgaaagcggtttgcgtggtgcgtatcgaatgcgacgccctcacctgccgccgacatctggcgactcagagcgaataagtcagatatcacaagcgccttatccggcctggaggcggtttacaggcctgataagcgcagcgccgttaatacaaaaaaggagccgtaaggctcctttttcttccatatcgcccatcaggcgtttttcaatacttcgctaacgatttcaacggcttctttctcaatctgcttgcgatgttcttcccccaggaagctttcgcaatagatcttgtaagcgtcttccgtaccggatggacgcgcggcgaaccagccgttgtcggtcattaccttcaggccgccaatcgatgcgccattacccggcgctgcggtaagacgcgcggtaatcgggtcgcctgccagcgtgctggcgctcaccatttccggagacagtttagacaatgccgctttctgggccgaggtcgctgccgcctgcagacggttatagctcggcgcgccaaaacgcgctgccagttcattgtaatgctcttgcgggtttttcccggtaacggcggtgatttccgccgccagcaggcacatgatgatcccgtctttatcggtagaccacggcgtaccgtcgaaacgcaggaacgaagcgcccgcgctctcttccccgccgaaaccaaagctgccgtcgaacaaaccgtcaacaaaccatttgaagccaaccggcacttctaccagcttgcgtcccaaatcattcaccacgcggtcaatcatcgcggaagagaccagcgttttaccgacagccacgtctttgccccacagcggacgatgctggaacagatagttaatggcgaccgccagataatggttcgggttcatcagccctgcaggcgtcacgatgccatgacggtcgtagtccgggtcgttggcgaaggccaggtcaaacttgtcacgcagcgccagcaaacccgccatcgcacattcggaggagcaatccatgcggatcgcgccatctttatcaaggtgcataaagcggaaggtttgatcaacctgatcgttgactaacgtcaggttaagcttgtaatgctcagcgatacgtttccagtattcaataccagagccgcccagcggatcaacgcccagcgtcagaccggctttctgaatcgccgccatatcaacgatatccgccagcccttcgacaaacggctgtaccagatctaccgctttaacgtgacccgaggccattgccgcatccagagagatgcgcttaacgccttgcaggccatccgccagcagcgcattggcgcgatcttctaccactttagtgacgttggtatccgccgggccgccattgggcggattatatttaataccgccatcttccggcgggttgtgcgacggtgtaatgacaataccatctgccagcgggccgccttttttgttatggaccaggatagcatttgacacggcaggcgttggcgtgaagccattattttcctgcacgataacgtctacgccgtttgccgccagcacttccagcacggaaatgaaggccggttccgagagcgcatgggtgtctttccccacatagcaggggccggtaatgccatttttcgcccgctcttcagcaatcgcctgggcgatcgccagaatatgcggttcgttgaaactgtgacgacctgcgctgccgcgatggccggaagtgccaaatttcacggcatgttctgcattccctgcctccggtttcagtacataatactgcgctgtcagttgggcgacgttaatcaaatcactctgttgcgcgggttgtcctgcgcggttgtggattgccattgcctggtccttctaatgcaaggattaaattgttccgcaaaccttttcaatcaattccgccgggaattgcattgactgcatgatgtgttcgatcatgctgcatttacggccggtgttggtgttggtgatcacccagtacggcgtgccgggaacgtgcttaggtttagtttgattcccatttttcagcagcgtttgttcatccgccgcaaaatagacgcgcgtgcggccatgcaacgactccgtcgcctccgcaaacgcgtggtgatccagtgaatagagtgtagtcagaatcagcataaagcggttgaccgcttttttctgctcggcatattcatcagacaacaacagctcacgcatcgcgcgaactttgtcttttaccgggttaaccggtttcgcttcggcaacgggttgcgccgcaggcgtccccttcaccgctgaagccgttggctgtgtcgtggcggaaaacttcaacatacgccgtaaaatgtcggatgcgctctcgccgatatgcttggtgtggctggcaatatagctatagagttcatcatcaacttcaatcgttttcatcttaatccagtgcgatgtctttgctgaatacaagtcattgggattataggaacaaatcccaacagcggatagcgttaagcccggctgacaaaaaaactcggagtaaaccttagaggttgcagcccagtggcagaatggtcaacataataccctaacccgacagagcgaaaaaaagaactttgccatgaaattaaacatccgagcgcaatctgcacaaaacctgcacaataattcccccatcgttctcgttcatggcctgtttggcagcctggacaacctcggcgtactggcgcgcgatctggtgaccgatcacgacattattcaggtcgatatgcgcaatcatggtttatcgccgcgcgatccggtcatggattatccggcaatggcccaggatcttctggatacgcttgacgcgcagcagattgaaaaagcgacgtttattggtcattccatgggtggaaaagcggtaatggcgctgacggcgctggcgcccgatcgcatcgatcgtctggtcgcgattgatatcgcccccgtggattatcacgttcgccgccacgatcgcattttcgcggccattaacgccgtcagcgaatccgacgcgacatcccgccaacaggcggcagggattatgcgccagcacctcaacaaagaaggcgtgatccagtttctgttaaaatcctgggctgaaggcgaatggcgttttaatgttccggtattatgggagcagtatccgcatatcgtcggctgggaaaccattccgccctgggaacatccggcgctgtttattccaggcggtaactcgccgtacgtgaccgaagcgtaccgcgacgcgctgctggcgcaattccctttggcgcgcgcgcatgtgatcgccggcgcgggccactgggtacatgccgaaaaaccagaggcggttctgcgcgccatccgccgttatctgcacgataaacgctaactgattaaaaactcatcgcctgtgcgcgattacgcgcgcgagcgttggcgtcgcttcctcgctgatgtatgatggcgcgctatccatccgggcataagcctggctgattgtttcccccgaagtcaccaaaatcatggccaaagaacaaacggaccgtacgacattagatctgttcgcgcacgagcgtcgcccgggacgacctaaaacgaatccgctttcgcgcgatgaacagttacgcatcaacaagcgcaaccagttaaaacgcgacaaagttcgtggcctcaagcgtgtcgaattaaaactcaacgcacaagcggttgacgcgctgaatgagctggccgaagcgcgcaacattagccgcagcgagctcattgaagaaatattaatgaagcagcttatggcgctgcgcggccagggtttagtctgaaaataagttttgtttcatatttcgtgtagcagagcgtgcagtcccgcgtgattgctgtttccgcatatctgcctgttctgctatgattgcccttatccgtgggcaattcgccaccaccatttcaataagtttcaagaggttattttactcatggcaatcactggcatctttttcggcagcgacaccggtaataccgaaaatatcgcaaaaatgattcaaaaacagcttggtaaagacgttgccgatgtgcatgacattgcaaaaagcagtaaagaagacctagaagggtatgacattctgctgctgggcatcccaacctggtactatggcgaagcgcaatgtgactgggatgacttcttcccgactctcgaagagattgactttaacggtaagctggtggcgctgtttggctgtggcgatcaggaagactacgcggaatacttctgtgatgcgctgggcacgattcgcgacattattgagccgcgcggcgccacgattgtgggtcactggccaaccgcaggctatcattttgaagcctctaaaggtctggctgacgacgatcattttgtcggcctggcgattgacgaagaccgtcagcctgaactgaccgccgagcgtgttgaaaaatgggttaagcaagtttcggctgaattgcacctcggcgacatcctcaacgcctaatcttatgcggcgcagcgttatatctgcgccgcatcaatagacaagaccaatcaaaataattgctacaaatttgtaactttcgcacccatccctgtacaatgtccgggtgtaatcaggtggcgccagaatttgcaggcaaaaccacagttttattaacatctgcgagagacttgcggttttcatttcggcatggcagtcctataatgatacgcattatcttgagtgcaatttctgtcacttctctaatgaagtgaatcgtttagcaacaggacagattccgcatgactgacaacaataccgcattaaagaaggctggcctgaaagtaacgcttcctcgtttaaaaattctggaagttcttcaggaaccagataaccatcacgtcagtgcggaagatttatacaaacgcctgatcgacatgggtgaagaaatcggtctggcaaccgtataccgtgtgctgaaccagtttgacgatgccggtatcgtgacccgccataactttgaaggcggtaaatccgtttttgaactgacgcaacagcatcatcacgaccatcttatctgccttgactgcggaaaagtgattgaatttagtgatgactctattgaagcgcgccagcgtgaaattgcggcgaaacacggtattcgtttaactaatcacagcctctatctttacggccactgcgctgaaggcgactgccgcgaagacgagcacgcgcacgatgacgcgactaaataagtgtaaatctttcgaagagccaaccgcccggttggcttttttatatcctcctctttcctgccgcttgatgttgatttaatgtaaaaaacgctatcgcatctcaggagagcaggaatggagcttcgccagttacgctatttcgtgcgtattattgaaaccggcagtatgggcagcgccgcacaggatcttgatattggcgtttcagcattgagtcaacagatgtcccgtctggaaaacgagctcgccatccgtctgctgcagcgcacctcgcgcggcgtaacgccaaccaacgccgggctggccttttattcacaggcgcaactcgccctgcgtcatgccgacgacgcgattctcgccgccagagaagcgcgcctttccggtcatgtgagcgtaggaatggcccccagtaccgcctccatactgggtataccgtttatccatgccatgcaggaaaactatgccgatgtccgactgcatgtggtggaaagcttgtccggtaatctggaaagaatgatcaatacccgccagattgatttagccgttgtctttcaaaaagataaaatcctgcgctggagcgccagaccgatccttgaagaacagctttttctgattggctcccatgccctgctggcggcgcttcctgataacccgatcacacctgaacaactggcaggcattccgctcattatgccaagccagggacatgggctgcgcggcaggctggacgctgtctgcaaggaacatgcgcttaatgttgaaatcgtcgcggaaattgacggcctggcgttgttgatgcgcgccgtgcgcgacggtcttggcgccacgttgcagcccggcgcggcgatttctcatctggataacgacgcgctacgcgtgatcggcgtccataatccggtactcagccgccccaattttttagtcagcctgtcggatgatgaactgacgcccgccggccttgccgccagagtagtccttaccaaagttatgcgtcagttagtcgacgccggtgaatggccaggcgcaaccctttacgcttactaaacccctgtttagcgctacctgatagcgcgccgcttatttatccgtatacatttcaattacaaatttaacaaatagttaaatggtacgggagtataagatggttgatgtactggtgataggcggaggcaatgccgcattatgcgccgccctgaccgcacgggaagcgggcgcatcggttctgctgctggaggctgccccgcgagaatggcgcggcggaaattctcagcacacacgaaacctgcgctgtatgcatgatgcgccgcaggatgtgctggtggaaagctatcctgaagaggaattctggcaggatctgtggcgagtcaccgacggcaacaccaacgaggcgctggcgcggctggtcattcgcacctcttcgcaatgccgcgactggatgcgcaaacatggcgttaactttcaaccgccactatctggggcgctccacgttgcgcgcaccaatgcgttttttatgggcggcgggaaagcgctcgtcaatgcctattaccgtagcgccgaacggctgggcgtacagattcgctataacacgccggttcacgcgcttgaacttcatgacggcgaattcgtggcggcgctggcgggtagcgaacgtattaccgccaaagcctgcgtattagcggctggcggtttcgaatcaaaccgtgaatggctgcgggaggcctggggagaaaacgcccgcggcgaatggcccgcggataatttcctgattcgcggcacgcgttttaaccagggcgtattactcaaatttatgatggatgccggcgcggatatcattggcgatccgtcccagtcgcactgcgtagcgattgatgccagggcgccgctgtacgacggcggtatttgtactcgcgtggattgcgtatcgctgggtattgtcgtgaatcgcgacgccgagcgtttttatgatgaaggcgaagatttctggccgaagcgttacgccatttgggggcggctggtggctcaacagccaggacaaattggctattcgattattgacagcaaagccattggccactttatgccgccggtttttcctggcgcgcaggccaatacgctggctgaactggcctgccagttggggctggacgcggaaaaatttacccataccgtcacgcagtataaccaggcctgccagcccggtcattttgatcataccttgcttgatgactgcgccaccaaaaacctgacgccggcgaaaacccactgggcgcgcccgcttgatgcgccgccctactacggttatgcgctgcgacccggcatcacgtttacctacctgggcctgaaagtcaatgaacgtgccgcggtgcattttgccggtcatccaagccgcaacctgtttgttgccggcgagatgatggcaggaaatgttctgggcaaggggtataccgcaggcgtaggcatgtctatcggcacaacctttggccgcattgcgggaatagaagccgctcgcgcggcgcacaaggaggcgcagcatgaaacagcttgaaaaattaatcattgaggccaccgtgcttaccgaaccggaagccgaggtcgaacgcgtcatgcaagtgtgtaacgcgtgtcgctactgcgaaggtttttgcgcggtatttccggcgatgacccagcggctcgaattcggtaaagccgatattcattatctggcgaatttatgtcataactgcggcgcctgcctgcacgcgtgccagtacgcgccgccccatgaatttgccattaacgtgccgaaagcgatggcgcaagcccgcctggagacgtatcaacagtatgcccagcccgccgcttttggcgcgttataccgtcgggcggggatcaccgtcgcgctggcgctgatagtcggtctgacgctctttttattactggcgatggcgctgaaagggtcgctgattcatccgccgctggccggtgacttctatcaaatttttccgcatagcctgctggcatggatgtttggctcagtttttgtgctggcaatcggtttgcttatggcgggcgtaatcagcttctggcgtgagatctcgccgggtgtaccgcgttcggcggagattgcggaagcgtcgcacaatgcgttaacgctgaaatatctcgacggcggtcacggcaaaggctgtaacgaagcggacgatgcgttcacgctgctgcgccgtcgctttcatcactttaccttttacggttttatgctctgttttgccgccacggtcgtggcgacgggctatcactacgtcgccggttgggaagcgccctacccgttctttagcctgccggtcatgctcggcacgctgggcggtatcggtctgcttatcggcccggccgggctactgtggctcaatctgcggcggtcgccgttacatagcgatgcgcgccagaaacccatggatcgcggctttattctgctgctgttcttaaccagtcttaccgggctggcgctgctggcaggcagagacaccagcggaatgggcatactgctggcgctccatttaggcgtggtgatggcgctctttctcacccttccctacggaaaattcgcccacggatttttccgctgcgcggccttactcaaatgggcagttgagaagcgacgcggaaaacatgcgggggatacaggcaactgacccgcaacatcttacctataaaacaataaagacagtggagagcaaaccctatggcacaacacacacctgcaacatcgcgcgccggcacgttcggcgcaatactgcgcgtgacaagcggcaatttccttgaacagtttgattttttcttgttcggattttacgccacctatatcgccagaacgttttttccggcggaaagcgaatttgcctcattaatgttgacctttgccgtctttggctccggttttttaatgcgccccgtcggcgcgattgtgcttggcgcctatattgacagaatcggacgtcgtaaagggctgatggtgacgctggcgattatgggctgcggtacgttgctcatcgccctcgtccccggctaccagacgatcggcctggcagcgcctgcgttggtgttgttgggccggttattacaaggattttctgcgggcgttgagttaggcggcgtctcggtctatctgtccgaaatcgcaacgccaggcaataaagggttttataccagctggcaatccgccagtcagcaggttgcgatcgttgtcgccgcgttgattggttatagcctgaatatcacgctgggacacgacgcgatatcggagtggggctggcgaattccgttctttatcggctgtatgatcattccgctgatttttgttttacgtcgttcattacaagaaacagaagcgtttttacaacgcaagcatcgccccgacactagggaaatttttgcaactatcgccaaaaactggcgcattattacggccggaacgctgctggtggcgatgaccaccacaacgttttattttatcaccgtttatacgccgacctatggcagaaccgtgcttaatctcagcgcgcgggacagtttgatcgtcaccatgttagtgggggtgtccaattttatctggttacccattggcggcgcgatttccgaccggattggccgtcgcgccgtgttaatgggcattacgttgctggcgctgatcaccacctggcccgtcatgcagtggctgaccgccgcgcccgactttacccgcatgacgctggtactgctgtggttctctttcttttttggcatgtataacggcgcaatggtcgcggcgttaaccgaagtgatgccagtctatgtgcgtaccgttggtttctcgctggcctttagcctggcgacggcaatttttggcggcctgacgccggccatctctaccgcgctggtaaagttaaccggcgataaaagctcgcccggctggtggctgatgtgcgcagcgttatgtggacttgccgcgacggcgatgctgtttgtacgtctgagtcgcggctatatcgcggcagaaaataaagcctgaaaaaaccacaggcggaaaacattcgcccgtgggtggcaaggcagggttttattgcacgttattatgactgcgaatttcctgccagaccttatcgcagtcagccttgaccgcctgatcgttacccgtgcgcgtcgcctgaatgcactgctgatagtccagtacccgcacgctttcttcgttagcaaattgctgatgtttgcgctcttttttaaggacattcagtacgctttggcaggcctctatcttctcaggcgagccctgtgcggtattgatacaggcgctgtacgcctctttcagccgactatcttcttccggcgcgggtgatgacgcgcaggccgtcaaaccggcggtcatgctggcgatgagtaaaatttttttcataggtcgttcctcaacagcgcggcagaccggcagcctgccgcatctgacatcagaaaatagtgaatggcgcaataacgataaatttcacgtcacgttcatcctggaagatgttgccgtaaccaccgccccagcttggaatattggagtggttgtcatattcggtgaagtgcagtttgaacatggtgcctttggcacgcccctcctgcagggtatagaccgcatccagactgtatgaggactcttcgatagtgcggtttttgtcgtagtaagcatccgggttactttgccaggttgccggtttagcatcccaggcgtaaacgtaagacgcgcccacagcccagcccggcagattccagtttttcaggtcatacatcgcgccgaagaaaaccgccttttcaccgttagcgttaaagtcggagcggttatcccaccagatatccagacgaccgtttgaagaggcgtaggttggcgtcatacgttgcagaaaatagccctgctgaccgtccgctttcacccaggtgccctccagacgcaggtcaaccacttccgcgactttgtagccgaaggtcaacgcctgcagccaggccgtaccgtcgtaaatgtcattcacgctgcgatcgtctactttgtcgcgcgcgccgtagaactggtaactggtggtgaacggattgccgcctaaatcaaatttatagctggcctttgcgaaatattgatcgacatagccttcggactgaccaaacgccgcttccagcaccagatcatttttgaagtcgtacttcgcgccgatggagtggagatagtctacattggtttttttatccgcctgataaaacttatccatttcggtatgccacggcgctttatattcgttagtccacatgtaggaaaaacttaacgcgcccgcatcgccatagtcaaaactggcgccggcttccgcaccctgataggtacccggcataaaactccagtgcggcgctaacagcgtctgaccggtaggctgaatataaccggcgcgcgcccagaccgggccatatttaaatttcgcggcggctttataaagactgataccgctcttatcgccggaatagtcttcgtcgtagcctttattctttttcgagaaggcaatttcgtttggatgaccgctgtcgccgttttctgccatttcaatcgcggtaaacgccgcgatatccagaccgaacatatccgcagcgtaaccagactgaaaatccaggttagcgttccaggtcgcatgagaaaggttagttttatatttgtcgccgtcggtcacatctttgcgatcgcgttcacgctgccaataatagatgccgcccgttaacgtggagtcgtcgaaaaagccggaggcttgcgcctgcggaacaacgatccaccccgacattgctgtgataccggcgatagccagagccagcgtactacgtttgccactaaacgtacgcataagttaatcctctttgacgtataaattgctgccgacaaaagcgaacagcgaaaaaataaaaataaaaagtagcgctgagaaacctcatttactacgttaaatagactatttttcgcgatgcgaattatcaatctctttctgtaaccagtatgtaataatatgagcaaccgcacatatttaattgctttctgttacattcgactgctggtgggggaagcagaccgccagaaagaaaattgacttgttttccataggcatgaaaataattgtctcctgttgacctgacgcttataacatttagattaataatcatttatcagatcaataattttcagagaataattaattcgcctcgcaaaaaagagaatcgacttagaaatgcagagaaaaaacgccgcagaacgcggcgttgacaaggtatttttacagcattcgcctgttggcgcagtgcttattcgcccgctttcgcccaggtatcacgcaggcccacggtgcggttaaagaccagcttatcggccgttgcatagcggctgtcaaggcagaagtaaccttcacgttcaaactggaaagctttccctgctaccgccgctttcagcgacggctcgccatacccctgcttaatcactaatgattcggggttgataacagacaggaagtcctccgcggcgcccgggttcggcacgctgaacagacggtcgtagagacgaatttcaatcggcagcgcatgtgctacgctaacccagtggattacgcctttcactttacgcccgtcagccggatctttactcagcgtatcagcatcataggtacagaagatggtggtgatattcccttcggcatccttctctacgcgctccgctttaatgacgtaggcattacgcagacgcacttctttgcccatcaccagacgtttgtactgtttgttcgcttcttcgcggaaatccgcgcgatcgatccagatctcaccgctaaacggcacttcacggctgcccatctccggtttattcggatggttaggcatggtaaccatttcgctctcgccctgcgggtagttttcgataaccagttttaccggatcgattaccgccatcgcgcgcggcgcgttttcgttcagatcttcgcgaatgcaggattccagcgacgccatctcaatagtgttgtcctgcttggtgacgccgatgcgtttgcagaactcacgaatagaagccgcggtatagccgcgacggcgcagaccggaaatagtcggcatacgcggatcatcccaaccttcgacgtgtttgtcggtcaccagcaggttcagcttacgcttggacatcacggtgtattccagattcaggcgcgagaattcgtactggcgcgggtgaaccggaatggtgatgttgtccagcacccagtcgtacagacgacggttgtcctggaactccagcgtacacagagaatgagtaatgccttccagcgcatcgctgatgcagtgagtaaagtcgtacatcggatagatgcaccacttcgtgccggtctgatgatgctcggcgaatttaatgcgatacagcaccggatcgcgcatcacgataaacggcgacgccatgtcgattttagcgcgcagacaggctttaccctcttcaaaaccgccggtacgcattttttcaaatagcgcgaggttttcttccacgctgcgatcgcggaacgggctgtttttacccggcgcggtcagcgtaccacggtattcgcggatctgctccggcgtcagctcatcaacgtaggccaggcctttattgatgagctcgaccgcataggcgtgcagttggtcaaagtaatcggaggagtagcgaatatcgccagaccagtgaaagcctaaccactcgacgtcgtttttgatcgaatcaacgtactcgatatcttcttttaccgggttggtgtcatcgaaacgcaggttgcactggccctgataatcttgcgcgatgccaaagttcaggcagatagatttcgcgtggccgatgtgcagatagccattcggctccggcggaaaacgggtatggacagtggtatgtttaccactcgccagatcttcatcaataatctgacgaataaagttagtcgggcgggcttcagcctcactcatcgtggattcctcaaagcgtaaacaacgtataacggcatatgatcttataagccggacagactgacaacctttagttacttaaaaagtggctttgcagaaaatattggggctaattgcggtaaaaaaaagcggcgaaggtttccctctgccgcttatgtttcctgtgatatcgccggatggcgtcttacgccttatccggccaggaagcgattatttgctcttgatctcgtacagcggcgtttgacccgctaccacgtgaccatccgctttgatgaccagagcgctgaagtcatcgctgttgctgcaaacaaccgggcttatcttggaacgcgcattggcattcaggaagtccagatccagttccagaaccggctgacccgccgtgacttccgcaccctcttctaccagacgcttgaagccctgaccgttcagcgcgacggtatcgatacccatatggacaacgatctccgcgcctttttcggtttccagacagaacgcgtggttagtgttgaagattttcacgatagtacccgccgccggagaaaccacggttttatcggtgggtttcaccgccacgccgtcgccgaccgctttgctggcgaaagcttcatccggtacctgatccagcgccactacctcaccggtaatcggagagaccagttcagcgatagtcaccgcattcggcaccgcctggggtttggccgccggagcaggtgtcgcaacgtgagccgcatcagcagacgctgccgcgaccggcccccgcgccaccactttcttcatttcatcgccaatcgattccgctttcgcgccgacaataacctgaatggtctgtttgttcagtttcaccacgccggaagcgccgaggcgtttgcaggccgcatcgttgacgcgagcagagtcgttcacggtcaggcgcagacgggtaatgcacgcatcgaccgctttcaggttgtccgtaccgccaaccgcagcaatatagctggtcgccagttgcgttaacccttcttcggtgttgctgttggcttcttccgttaccatctcatcaactttatcttcgcggcccggcgttttcaggttaaacatacgaataaccgcgctgaacagcaggaagtagatgataaagaatacaacgcccatcaccagcaacatccagacgttattgctggccgcaggcaggttatacatcagaacatagtcgatcgcgcctgccgagaaagagaagcccgcatggatacccagcaacgtcgcgacgaacaggctgataccagtcaaaatggcgtgcaggaggtacagcagcggcgccaggaacataaacaggaattccagcggctcggttacgccggtcagaaacgcggtgatcgcgacagacagcagcataccgcccaccatcggacgacgttctttcggcgcggcgaaatacatcgccagagcggcgcccggcagaccaaacatcatgatcgggaagaagccggacataaacatccccgccgtgccgtcgccagcatagaagcggttgatgtcgccgtggaatacagtgcctgcggcattggtgaattcgccaatctggaaccaggcgatggtgttcagtacctgatgcagaccggtggggatcagcagacggttgatgaagccaaagataccggaacccaacgcgcctgcggaaacgatccattcaccgcccgcatggatgccatgctgtaccggcggccagacgtaaccgaaaatagcggccagcaccagacagaaaaagcccgttgcgatcggcacaaaacgttttccaccgaagaaactgagaaaatcaggcagtttgataccagaccagcgattataaaccgcgccgccgaccagaccggtaataatccccgccagcacgcccatgttgatttccgggttaatcgtcaccatcgctttggtcatgacgaagtaacccacggctcccgccagtgctgccgcgcctgcgctatctttagaccaactggaggccacgccgatagcgaaaaccagcgccaggttatcgaaaatagacccgcccgcttgcgcgataaacggcatattcagcaaatctggttggccgaatcgcagcaacaacgctgccaccggcaacacgacgatagggagctgcaacgccctacccagccgctggaaaaaacctaaaatattcatcttattccccctacgagacgccgatatggcttctttgaagccgttttttattgtgctgcaaacgttaaaaacgtgatgttctgtaatcgaacggtgagatcatcttctgcagagtgtgtggaaaattaattcgcctcgcaaattaaacgggtgttttttgtgattataatcactaaatatcgtaatcacccccaccatccactggctaacacggaaaacttattttatgattcaaaaaatcaggacggattgaacacgaaccctggatatccaggttacgcttaatacgatccgccaaattttgacattgattattgaggtgaagaatgagactgatccccctgagtaccgcagaacaggttggcaaatgggccgctcgccatatcgttaaccgtattaatgcgttcaaaccgaccaccgatcgtccgtttgttcttggactgcctaccggcggcacgccgctaacggcgtacaaagcgctggttgagatgcacaaagcgggcgaggtcagctttaagcatgtggtcacctttaatatggacgaatatgttggcctgccgaaagagcacccggaaagctaccacagctttatgcatcgtaactttttcgatcacgttgatattccagcagaaaacatcaatcttctcaacggtaacgcaccggatatcgatgcagaatgccgtcaatatgaagaaaaaattcgttcttacggtaaaatccatctgtttatgggcggcgtcggcaacgacggtcacatcgcctttaacgaaccggcgtcttccctggcttcccgtacccgtatcaaaacgttaacccatgatactcgcgtagcgaactcccgcttctttgacggcgacgtaaaccaggtgccgaaatacgcgctgacggtaggcgtgggtacgctgctggatgcggaagaagtgatgattctggtgctgggccatcagaaagcccaggcgctgcaggcggcggttgaaggcaacgtcaaccacatgtggaccattagctgcctgcaactccatccgaaagcggttgtggtatgcgatgagccgtccacaatggaacttaaagttaaaacattgaaatatttcaatgaattagaagcagaaaatattaaaggtctgtaatgttgtctccgccccgccagtcaatgcggggcggtaaatttttgatatcgggggtcagaatgtatgctttaacccagggccggatctttaccggtcacgaaattcttgatgaccatgcgcttgttgtcgctaatggcctgattgaccgcgtttgtccgatggccgagctgccgccgggaatagaacaacgctcattgaatggggccattctctcccccggttttattgatgtgcagctaaacggctgcggcggagtgcagtttaacgataccgcagaagccgtcagcgttgaaacgctggaaattatgcagaaagccaatgaaaaatcgggctgtactaactttctgccaacgcttatcactaccagcgacgaattgatgaaacagggtattcgcgtcatgcgcgagtatctggaaaaacatccgcaccaggcgctgggtctccacctggaaggcccctggcttaatctggtaaaaaaaggcacccataatcctgatttcgtgcgtaaaccagacgctgcgctggtcgatttcttatgcgataatgccgacgtcatcaccaaagtcactctcgcgccggaaatggtgcctgctgacgtaatcgctaaactggcgaatgcgggcattgtggtttccgcaggtcactccaacgcgacgttaaaagaggcaaaagcgggcttccgcgccgggattacctttgcgactcacctgtttaacgcgatgccgtacattacagggcgtgagccgggccttgctggcgctgttctggacgaagcggatatttattgcggcgttatcgccgatggtctgcatgtcgactacgccaacattcgcaatgccaaacgcctgaaaggcgacaaactttgtctggtgacagacgccaccgcaccggcgggggccaatattgagcagttcattttcgcaggtaaaacaatatactaccgcaatggactgtgtgtggatgaaaacggtacgttgagcggttcgtccttaaccatgattgaaggcgtacgcaacctggtcgcgcattgcggcatcgcgctggatgaagtgctgcgcatggcaacgctctatccggcacgcgctatcggcgttgataagcatctcggtagcattgcgccgagtaaagtcgccaacctgaccgcgttcacccacgattttaaaattatcaagaccatcgttaatggtgacgaggtcgttgacttgagtaagtgagaatatgacaccaggcggacaagctcagataggtaacgttgatctcgtaaaacagcttaacagcgcggccgtttaccgcctgattgaccagcatggtcctatctcgcgcatacaaattgccgagcaaagccagcttgctcccgccagcgtaacgaaaattacgcgtcaactcattgaacgcgggctgatcaaagaagtcgatcagcaggcctctaccggaggccgccgcgctatctctatcgtcacggaaacccgtaacttccacgccattggcgttcgcctggggcgtcatgacaccactttaacgctctacgatctgagcagtaaagtggtcgctgaggagcattatccgctgccggagcgcacccaggagacgctggaacatgcgctgctcaacactatcgccgtctttattgatagttgtcagcgtaaaattcgtgaattgatcgctatctcggtgatcctgccagggcttgtcgatccggaaagcggcgtgattcgttacatgccgcacattcaggttgaaaactggggactggtcgaagcgctggaaaaacggtttcacgttacctgtttcgtgggtcacgatattcgtagcctggcactggcggaacactacttcggcgccagtcaggattgcgaggactcgattctggtgcgcgtccatcgtggtacaggtgccgggattatctccaacggacgcatcttcattggccgtaacggcaacgtcggcgaaattgggcatattcaggtggagccgttgggcgagcgctgccactgcggtaatttcggctgtctggaaaccattgccgccaatgcggcgattgaacaacgggtgctgaatttgcttaaacaagggtatcaaagccgtgttccgcttgacgactgcacgattaaaaccatctgtaaggcggcaaaccggggcgacagcctggcctcggaagtcattgagcatgttggccgccatttgggcaaaacgatcgccattgctatcaacctgtttaatccgcaaaaaatcgtcattgccggcgagatcattgaagccgataaagtcctgttgcccgctatcgaaagctgtatcaatacgcaggcgttaaaggcctttcgcaaaaatttgccggtggtacgctccacgctggatcaccgttctgctatcggcgcatttgccttagttaaacgcgccatgctcaacggaacattgctgcaacgtttgctggaaagctgatgcgctcttatagtatcggattattcacaaattccctgggtagttcatgaccatcaagaatgtaatctgcgatatcgacggcgtgctgatgcacgacaacgtagccgtacccggtgcggcggaatttctgacggggattctggaaaaaggtctgccgctggtgctgctgaccaattacccgtcgcaaaccggccaggatctggcgaaccgttttgctaccgctggcgttaacgtgccggacagcgtgttttatacgtcagcaatggcgacagccgattttctgcgccgtcaggaaggtaaaaaagcgtatgtcgtgggcgaaggcgcgcttattcacgagctctataaagcgggttttaccattaccgatgtaaaccctgattttgtcatcgttggagagacccgctcctacaactgggacatgatgcataaagcagcatttttcgtcgctaatggcgcgcgctttatcgccaccaacccggatacccacggtcgcggcttttatccggcctgcggcgcgctgtgcgcaggcattgaaaaaatttccggccggaagccgttttatgtcggcaaacccagcccgtggatcatccgcgcggcgttaaacaaaatgcaggcgcactcggaagagaccgttatcgtcggcgacaacctgcgcaccgacattctggcggggttccaggccggtctggagaccattctggtgctttcaggcgtatcaacaatcaatgatattgacagtatgccgttccgcccaagctggatttacccttccgtcgccgagatagacgttatctaaacctgtcccctgcctgatgacgcgccgctttcaggcctacggttcgaacaacattgtaggcctgataagcgaaacgtcatcaggaaaaacataattcaattaaaccactataaaactgaagattcatcaataaattcgcgcaatacgtaatcatttttcactaatcaacaatgacgattgcgtttttcatttttcagaccgtaatccccttgcgccttccacgcctttgcggcattttttagtcaagcaaacacaaaaagtacgacgcaacagattaacggagaaggctatgtgttctattttcggcgtattcgatatcaaaacagatgcagcggaactgcgtaaaaaagcccttgaattgtcacgcctgatgcgccatcgcggcccggactggtccggcatctacgcttgcgataacgcgattctcgcacatgaacgcttgtcgattgttgatgttaacgccggcgcccagcccctgtataacgctaagaaaactcacgtgctggcggtgaacggtgaaatttataaccatcagacgttacgcgcggagtatggcgatcgttacgcgttccagactggctccgactgcgaagttattctcgcgctatatcaggaaaaagggccggatttccttgacgatttacaggggatgttcgccttcgccctgtatgacagcgaaaaagacgcttatctgattggtcgtgaccatatcggtattattccgctctacatgggctatgacgaattcggcaacttctacgtagcgtcagaaatgaaagcgctgactccggtctgccgcaccattaaagagttcccggcgggcagctacctgtggagcaaagacggcgaaattcgtcagtactatcagcgcgactggttcgattacgatgcggtaaaagataacgtcaccgacaaaaacgcgctgcgtcaggcgctggaagaatccgtgaaaagccacctgatgtccgacgtgccctacggcgtactgctctccggcggcctggactcgtcggttatctcggcaatcaccaaaaaattcgccgcccgtcgcgtcgaagatcaggagcgctccgaagcctggtggccacagttgcactcttttgcggtaggtctggaaggttcgcctgacctgaaggcggcccaggaagtggctaaccacctcggcaccgtgcatcatgaaattcacttcaccgtccaggagggtctggatgcgattcgcgacgtgatttaccacattgaaacctatgacgtaaccactatccgcgcctcaacgccaatgtatctgatgtcgcgtaagatcaaagcgatgggcatcaaaatggtgctctccggcgaaggttctgatgaggtgtttggcggctacctgtacttccataaagcgccgaacgccaaagagttacatgaagagacggtccgtaagctacaggcgctgcatatgtatgactgcacccgcgccaacaaagcgatgtccgcctggggcgtggaagcgcgcgtaccgttcctggataaaaaattcctcgacgtggcgatgcgtatcaacccacaggataaaatgtgcggcaacggcaagatggaaaaacacgtgctgcgcgagtgcttcgagtcttatctgccagcaagcgtggcgtggcgtcagaaagagcagttctctgacggcgtaggctacagctggattgatacgctgaaagaggtggcggcgaaacagatttccgatcaacaactggaaacagcccgcttccgctttccatacaacacgccgtcgtctaaagaggcgtacttgtaccgggaaatttttgaagaattgttcccggtgccgagcgccgcggaatgcgtacccggcggcccgtccgtggcctgttcttccgccaaagccattgagtgggatgaagcattcaaaacgatggatgacccgtcaggccgcgcggtcggcgtgcatcagtcggcgtaccagtaaattaacgatgacgaaagagcccctaggggctctttttttatagcaacccactttcggaaaaacgattaataaccaataattgccgaatattgcgccacgctgttcgcaacctaaccaaacagacactttccgacgtttttcgatgaaaaagaggttgacgcttcaaggctcaatacgcataatgcgccccgcaacgccgataaggtaacgcgaaaaaagatggctacgtagctcagttggttagagcacatcactcataatgatggggtcacaggttcgaatcccgtcgtagccaccatcttttttgcgggagtggcgaaattggtagacgcaccagatttaggttctggcgccgcaaggtgtgcgagttcaagtctcgcctcccgcaccattcaccgataagcgttgtacggatggggtatcgccaagcggtaaggcaccggtttttgataccggcattccctggttcgaatccaggtaccccagccatatttcttcgagtttgcggttcaccgcgacggtattggggtatcgccaagcggtaaggcaccggtttttgataccggcattccctggttcgaatccaggtaccccagccatcgaagaaatcatctggctacgtagctcagttggttagagcacatcactcataatgatggggtcacaggttcgaatcccgtcgtagccaccatattcagaacgcgtcgaggtattcgaccggttcgaaaataatttgttggggtatcgccaagcggtaaggcaccggattctgattccggcattccgaggttcgaatcctcgtaccccagccacttttaaaaagctcgcttcggcgagctttttgcttttctggcaattcggacagcctgatggcgctacgcttatcaggcctacgggcgaatacaggccgggtaaggtatagccgccacccggcataacacaaactacaaccccaacgcatacttcagcgcctgacgttttagcacgcctgcgcgctgcgccgccattagccccatattgcgtaaaatacgcagtggcggcagttcattgctgaacccggcataaaacagatccattccactttgcatcataaaattatctgccatgcgccgcgtctgatagcgtttcaacaccgaatggctggcccaggactcgccatagctacgggcactcgccagcacatcaatcaacgcatcaacatcccgataccccaggttgacgccctgcccggccagcggatgaatggtatgcgccgcgtcgcctaccagcgccagccccggttgcgcatactgcaacgcgtgacgacgggttagcggaaacgcgcccgccgcgacaggcatcaccgcccccagacgcgccggaaagtgctggttaatttccacctgcaattgcgtcatcgataaactctgtagctggcgaatacgtgccggagcgtcataccacaccagcgacgcccaatcgtcgaacagcggcaaaaaggcgcgcggccccgttggcgtaaactgctgccaggtgctgtcgcctggcgcattttcacacttgacggtgataagcatacacgactgcgcatattgccaggcatgaatgccaattcccgccatttgccgaacctgcgaattcgcgccgtcggcgccaatcactaacttcggcgttacccattcgccgtcggccagttccagcgcataaccatcgtggcggcggtgcaatgccgccagtgaagccggaacgcgcagcgtcacgccggggtgcgcttccagcgcctgccacagcgcctgttgcaggacgttgttctctaccatatagcctaacagcggcagcttgagttcagcggcgtcgaacaccacatgggcgttttcccactcccaggtctccagtcgccgataaggatggctacgcatcccctgcaccgcctcccaaacgcccagccccttgagcagcgccacggatgccgcgctaatggccgaaatccgcacgtcaggctggctgtcagccacaaacggcgcaggcgcggcatgttctattaccatcaccgtaaacccttgctgcgccagacccagcgccagcgcgccgccgaccattcccccgccgacaatggcaatttccgttggttgatttgtcatggtcattcatcctgttacgttttagacaagtttacaggattttttacccattagggctgacgtcagtcatactggtcacaaccgcgccaaagcattacactatgcgccctgcttttcagccactatttcgcaagagcaagtcgatgactaaaaaactccatattaaaacctggggctgtcagatgaacgagtacgattcatcgaagatggccgatctgctggacgccacccacggctatcaactgaccgacgtggcggaagaggcggatgtgctgctgttgaatacctgctcaatccgcgagaaggctcaggaaaaagtcttccatcaattaggtcgctggagactgttaaaagagaaaaatcccgatctgattatcggcgtcggcggctgtgtggcttcccaggaaggcgagcacattcgtcaacgcgcccattacgtcgacattatttttggcccgcaaaccttacaccgcctgccggagatgattaactccgtgcgtggcgaccgcagcccggtggtcgatatcagcttcccggaaatcgagaagttcgatcgtttgccggagccgcgcgccgaaggcccgaccgctttcgtttctatcatggaaggctgcaataaatattgtacttactgcgtggtaccgtatacccgcggtgaagaagtcagccgtccctcagacgatatcctgttcgaaatcgcccagttagcggcgcagggcgtgcgtgaggtcaacctgctgggccagaacgttaacgcctggcgcggagaaaactacgacggcaccaccggcacctttgccgatctgctgcgtctggttgccgccatcgacggcattgaccgtattcgctttaccaccagccatccgattgagttcaccgacgatattatcgaggtgtaccgcgatacgccggagctggtcagtttcctgcatctgccggtacagagcggttccgatcgcgtgttgaatctgatggggcgcacccacactgcgctggaatataaagcaatcatccgtaaactgcgcgcggcgcggccggacattcagataagctctgactttatcgtcggtttcccaggcgaaactaccgatgatttcgaaaaaaccatgaagcttatcgccgacgtcaactttgatatgagctacagctttatcttctctgcgcgtccgggaacgccggctgccgatatggttgatgacgtaccggaagaagagaaaaagcagcgtctgtatattctgcaagagcgtatcaatcagcaggcgatggcatggagccgccgtatgctcggcacgacacagcgcattctggtggaaggcacgtcgcgtaaaaacattatggaactgtctggccgtaccgaaaacaatcgggtggtgaactttgaaggcacgccggagatgattggtaagtttgtcgatgtggaaattactgacgtctatccgaactccctgcgcggaaaagtggtgcgtaccgaagatgaaatgggtctgcgcgtcgccgaaacgccggagtccgtcattgcccgtacccgtaaagaaaatgagctgggcgtaggattctaccagccttaatcctgcaggaaaggcaataatgcccgatggcgctacgcctgtcgggcttcctggtcatggcctgtcgcccgacgggccttgcaattttctctcttcatccccatcttcattgcaatgcttgcgccttttccctatggcgtgaataatttccttagatgccggtaaatgttcagcgtccggcgatacagacacaagaggaacagtttgaatatagacactcgcgaaattacccttgagcccgcagacaacgcccgtctgttgagcctttgcgggccgtttgatgacaatattaaacagctcgaacgtcgtctcggtattgaaatcaaccgccgtgacaatcactttaaactgaccggtcgtccgatttgcgtgaccgcggcgacagatattttgcgaagtctgtatgtcgataccgcaccgatgcgcggccagactcaggatatcgaaccggaacaaattcatctggcgatcaaagaagcgcgggtgctggaacagagcgcggaaagcgtgcctgactatggcaaagctattaatatcaaaaccaagcgcggcgtgattaaaccgcgtaccccgaaccaggcgcagtacatcgccaatattctcgatcatgatattacctttggcgtcggcccggcgggtaccggtaaaacttatcttgcggtcgccgctgcggtagacgccctggagcgccaggagattcgccgtattctactgacccgtccggcggtggaagcgggcgaaaaactcggctttctgccaggcgatttaagtcagaaggtggacccgtacctgcgtccgctgtatgacgcgctgttcgaaatgctcggctttgaaaaagtcgagaagctgattgagcgcaatgtgattgaagtcgcgccgctggcctatatgcgcggacgcacattaaacgacgcctttatcattctggatgaaagccagaacaccactatcgaacagatgaagatgttcctgacgcgtatcggctttaactcgaaagcggtgatcaccggcgacgtgacgcagattgacctgccacgcaacaccaaatccggcttgcgtcatgccattgaagtgctggcggaagtcgatgaaatcagctttaacttcttccacagcgaagacgtggtgcgccatccggtcgttgcccgcattgtgaacgcctatgaagcctgggaagaggccgaacaaaaacgcaaagcggcgttggcggcggagcgtaagcgtgaagcccaggagcaggaacagaaatgagccaggtgatcctcgatttacagttggcctgtgaaaaccacgcgggcctgccggatgaagctcagtttcaacgctggctggacggcgttattccgcagtttcaggaagaggcggaagtcacaatccgtctggtggatgaggccgaaagccatgaccttaatttgacgtaccgcgggaaagataaacccactaatgttctctccttcccgtttgaagcgccccccggcattgaaatgccgctactgggcgatctgattatttgccgtcaggtcgtggagcaggaagcgcaggaacagagcaagccactggaggcgcactgggcgcacatggtcgtacacggtagcctgcatttgctgggttacgatcatatcgacgatgacgaagcggaagagatggagtctctcgaaacggagattatgcttgctatgggctatgaggatccgtacattgccgagaagattgcagaatagtagcttgccggatggcggcgcttgcgccttatccggcctacattcatgccttttgtaggcctgataagcgtagcgtcatcaggcaaaacatgccgtcacagctgagtatacgcatgacgagctttgtattaactaacatgagaacccatacgacgccatgagcgacgacaattcacacagtagtgacacagtaaacagtaaaaagggatttttttccctgctactcagccagcttttccacggtgaacctaaaaaccgtgatgagttgctggcgctgatccgtgattccgggcagaacgagcttatcgatgaagatacgcgcgatatgctcgaaggcgtaatggacatcgccgaccagcgcgttcgcgatattatgatcccgcgctcccagatgattaccctgaaacgcaaccagacgctggacgaatgtctcgatgttatcatcgagtccgcccactcgcgttttccggtgatcagcgaagataaagatcacattgaagggattctgatggccaaagatttgctgccgtttatgcgcagcgatgccgaagccttcagcatggacaaagtgttacgtaccgcggttgtcgtaccggaaagcaaacgggttgaccgtatgctcaaggaattccgctcccagcgctaccatatggccatcgttatcgatgagtttggcggcgtttccggccttgtgactatcgaagacatcctcgaactgattgtcggtgaaattgaagatgagtatgacgaagaagacgatatcgacttccgtcagcttagccgccatacctggacgattcgcgcgctggcgtcgattgaagacttcaatgacgctttcggcacccacttcagcgatgaagaagtcgataccatcggcgggctggtgatgcaggcgttcggccatttaccggcccgcggcgaaaccattgacattgatggttaccagttcaaagtggcaatggccgatagtcgtcgtattattcaggtgcatgtcaggatcccggatgactcgccccagccaaaactggacgaataacagcaatagtggactaaaaatggcatttgcctcgttaattgaacgccagcgtattcgcctgctgctggcgttattattcggcgcctgcggaacactggctttctctccgtatgacgtctggcccgcagcgatagtgtcgcttatcgggctgcaggccttaacgtttaatcgccgcccgctccagtctgccgccatcggctattgctggggactcggacttttcggcagcgggattaactgggtttatgtcagtatcgcgcagtttggcggcatgccgggcccggttaacgtttttctggtggtgctgcttgcagcttatctctcgctgtataccggactgtttgccgggattttgtcgcgcctgtggccaaaaaccaactggctgcgcgtcgctatcgccgcgcctgcaatatggcaaatcaccgaatttttacgcggctgggtgctgaccggcttcccctggctgcaatttggctatagtcaggtcgacggcccgctaaaaggcctggcgccggtaatgggcgtcgaagcgatcaacttcctgctgatgatggtcagcggcctgttagcgctggcactggcgacgcggaactggcgtccgctggctgtcgccgtgattctgtttgctttgccctttccgctacgttatatccagtggtttacgctggaacctaccaaagcgacccaggtatcgctggtgcagggcgatattccgcagtcgctgaagtgggacgaaaaccagctactgaatacgctaaacatttatctcaacgaaactcgcccagagttaggcaaatcacagattattatctggcctgagtcggcgattccggatctcgaaatcaatcagcagcctttccttcgttcgctggacgagatgttacgcgaaaaaaatagcacgctgatcaccggtattgtcgatgcgcgtctcaataaacagaatcgatacgacacctacaatacgattattacgttgggcaaggataatccatacagttatgactcgcccaatcgctacaataaaaatcaccttgtaccctttggcgagttcgttccgctggagtctatcctgcgtccgctggcgccgttcttcgatctgcccatgtcctcctttagccgcggcccttatatccagccgcagttacatgcgcacgactataagctgacggcggcaatctgttatgaaattattcttggcgaacaggtgcgggataacttccgcccggacaccgactatctgctgacgatttctaacgacgcctggtttggtaagtccattggcccgtggcaacatttccagatggcgcggatgcgttcgctggagctggcgcgtccgttgctgcgcagtactaataacggtattacggcggtgattggcccgcagggcgaaattcaggcgatgatcccgcagttcacacgccaggtgctaactaccaaagtcacgccgaccaccggcctgacgccgtacgcacgaaccggcgactggacggtgtggttgattaccgtactgttcggctttggcgcgctggtgatgagcctgcgtcaacgccgcaaataaaacattgcactatccaatgtaggccggataaggcgttacgccgccatccggcagttgtatcgcaccgtgcctgatggcgctacgcttatcaggcctacaacctctcaccgccaccaaaatctcattctggcacgccaattgcttaatataatcaagaggctgcacactccctaccggcgcaaccaggttgcaccacaacacagcatcggtagcaccattattgtgcaaactgcgatttttgcctctgaacggtgcggcgcacttcgcaaaaataaacaatatcgcagcaaaatatttacaacaagccacactaaatgttaacaaacacacataacactgcacgcgcaagttgcaggcaataacaacatcacaatagctatcaatgcgtcgacggcgcagatgataaaggagttggatatgcaattacgtaagctaaccacagcaatgctggtcatgggactgtctgcgggccttgcgcacgcagaagatggcgcgcctgccgctggtagcaccctggacaagatcgctaaaaatggcgtgatcgtcgtcgggcatcgcgaatcttctgtgcccttttcttattacgacaaccagcagaaagtggtcggctattcccaggactactccaacgccattgtggaagtggtaaaaaagaaacttaacaagcccgatctgcaggtgaagctgatcccgatcacctcgcaaaaccgtattccgctgttgcaaaacggaaccttcgattttgaatgtggttcaacgactaacaaccttgagcgccagaaacaggccgccttctccgatacgattttcgtcgtcgggacgcgactgctgactaaaaaaggcggcgatattaaagatttcccggatctgaaaggcaaagcggtcgtcgtcacctccgggacgacctctgaaattctgctgcataagcttaacgaagagcaaaagatggggatgcgtattattagcgcgaaagaccacggtgactcgttccgcaccctggaaagcggtcgcgccgtcgcctttatgatggatgacgcgctgctggccggcgagcgcgccaaagccaagaaaccggataactgggagattgtcggtaaaccgcagtcccaggaagcctacggctgtatgctgcgtaaaaacgaccctgagtttaaaaagctgatggacgataccatcgctcaggcgcaaacctccggcgaagcggaaaagtggtttgataagtggtttaaaaatccgatcccaccgaaaaacctgaacatgaatttcgagttgtctgacgagatgaaagccctgttcaaagcaccgaatgataaagcgcttaactaactaaaactaaatgggacgggactcctgtcctctcgattgtcgctcagcacggacagactataagcctgatggtcgttccccatcgggcctgaaaccgcagatcgccgggcaacaatcttcgagggtagcgctgctacccttttttttcggagtagatgtatgtcaatagactggaactggggtatttttttacaggaagcccccttcggcaataccacctatctcggctggctatggagtggttttcaggtcaccgtagccctttcgattaccgcctggattatcgctttcctggtaggatctattttcggcattttacgtaccgttcccaaccgtttcctctccggactgggcacattgtacgtagaactgttccgcaacgtgccgctgatcgtgcaattcttcacctggtacctggtggtgcctgaactgttgccggaagatcttggcatgtggtttaaggcggaactcgatcccaatattcagtttttcctctcctcaatgatctgtctgggactgtttaccgccgcccgtgtttgcgaacaggtgcgcgccgcgattcagtctctgcctcgcggacagaagaacgcggcgctggcgatggggctaacgctgccgcaggcttatcgctatgtcctgctgccgaatgcctatcgcgttatcgtgccgccaatgacgtcagagatgatgaacctggtgaaaaactcggctattgcatcaaccatcggcctggtggatatggcggcgcaggcaggcaaactgttggattactcggcgcacgcctgggaatccttcaccgccattacgctggcctatgtgctgattaacgccgttatcatgctggtcatgagcctggttgaacgcaaagtccgcctgccgggcaacgtggggagcaaataatgtacgaatttgactggagttcgattatcccctcactgccttacctgctggccgggttggtcatcacgctgaagatcaccgtcaccgccgttgtcgtggggatagtctggggaaccattctggccgtcatgcgcctctcaagctttgctcctatcgcctggtttgctaaagcgtatgttaacgttttccgttccatcccgttggtcatggtcttgctgtggttctatctgattgtacccggctttctgcaaaacgtgctgggactatcgccgaaaaccgatatccgcctgatctccgcgatggtggcattctccatgtttgaagcggcctactattccgagattattcgcgccggtattcaaagcatttcccgcgggcagtccagcgccgcgctggcgctggggatgacccactggcagtcgatgaagctcattattctgccgcaggcgtttcgggcaatggtgccgctgttgcttacgcagggcatcgtgctatttcaggacacctctttagtttatgtactcagcctggcggacttcttccgcaccgcgtcgactatcggcgagcgtgacggtactcaggtcgaaatgattctgttcgccggcgccgtttattttgttatcagcctgagcgcgtcgttgctggtcagctatttgaagaaaaggacagtttaatgattaccctgaaaaatgtttcaaaatggtatggtcactttcaggtgctgaccgattgttcgacagaagtgaaaaaaggtgaggtggtggtagtctgcgggccatcgggttccggtaaatccacgctaattaagaccgtcaacggtctggaaccggtgcaaaaaggcgaaattaccgttaacggcattattgtgaacgacaaaaaaaccgatctggcgaaactgcgttcccgcgtgggcatggtattccagcacttcgagctgtttccccacctgtcgatcatcgaaaacctgacgctggcgcaggtgaaagtgctgaaacgcgataaggccgccgcccgcgataaaggcctgaagctgctggagcgcgttggcctgtctgcgcatgccaacaagttcccggcgcagctttccggcggtcagcagcagcgcgtggcgatcgcccgcgcgctatgtatggaccccattgccatgttattcgatgaaccgacttccgcgctcgatccggaaatgatcaacgaggtactggacgtgatggtcgagctggcgaacgaagggatgaccatgatggtggtgacgcacgaaatgggctttgcccgtaaagtggctaaccgggtgatctttatggatgaaggtaaaatcgtcgaagattcgccaaaagaggagttcttcgctaaccccagttccgatcgcgcaaaggacttccttgcgaaaatcctgcactaatcttcccggcgcgcacgtcagagtgcgcgctacctcacgctttacttcttcgcttctcgaaacgtatccagccgggcgttaaccttgtcacaaagtaccgcttacaaggagccacaatggcactgcccattattattgattgcgatccgggtcatgatgacgcgatcgccctcgttctcgccctcgcctcccctgaactggaagtgaaagcgatcacctcttccgccggcaaccagacgccggagaagacgctgcgcaacgtgctgcggatgctgacactgctcaaacgcccggatattcctgtggcgggcggcgcggtgaaaccgctcatgcgcgaactgattatcgctgataacgttcacggcgaaagcggtcttgacggcccggcgctgcccgagccgtcattcgccccgcaaagcggcactgccgttgagctgatggcaaaaacactgcgcgagagcgcacagccggtcaccatcgtctccactggcccacagaccaacgtggcgctgctgctgaatagccatccggaactgcatacgaaaatcgcccgcattgtgatcatgggcggcgcgatggcgctgggtaactggacgcccgctgcggaatttaatatttacgtcgatccggaagcggcagaaattgtcttccagtcaggcattccggtggtgatggccgggctggacgtcacccataaggcgcagattcacgccgccgatatcgagcgtttccgcgacatcggcaatccaatttcgacgatcgtggctgaactactcgacttcttctttgaataccacaaagacgaaaaatggggatttgtcggcgcgccgctgcacgacccttgcactatcgcctggctgctgaaacctgagattttcaccaccgttgagcgttgggttggcgtggaaactcaggggaaatatacccaggggatgacggtggtggattattatttcctgacggggaataagccgaatgcgacggtgatggtcgatgtagaccgtcagggatttgtcgatttgctggcggaacggctgcaatactacgcataaagcgcaaagaagaatccagggatgaacagcgatgttttggcgtaacaatagacctgaaatcagcctgctacagcacgacgtagcccatataacgttttcagtacgtaacggaaaagcattgcttcgtccctgcattatccacgatcccgactctgacgccggtattcatatgctctcctggcatggctcgccgctgattcgtttttacactgaagcctggtgcccaacctgcgcagaatttgtttatgccggttttagcaatgatgatgaaggcgccgcgcagtttttatcctcacttgccgagtggaatcagccaggagtcgggttgaacgaagcatttaccgccctgacgccgctgttttcactctttgccgatggctattaccggctggaagcccaactacactcttaacatggcggacggcaaccgtccgctcacgataatgaaccttacggctcaaacggcctgcgctggaactgatcgtgcccacacttcgggcagagcggcagcacatccggcgtgtaaaccgccagatgatagtggcatttctcgcacaccagattccccaaccccaccacttcgccactgtgatacacgccgtggtgattcaaatcctggaagacttcacgccattccagctgggttttgtcggtaatatccgccagttcctgccagagactctctttaatcacccgcaagaagacgctatcttcctggctctcttcgtagctcatggcgaactcttccagatcgcgtctgacagcgcgcgtcagttcgtccacctcggttcgcgttaactcccctgtttgcatcacgcgctggcgcgcctgctccaccagcgcatcaatgtcgcgctcgccattgcgtaaacgctcgcttaatgaggccaccagttcacgataatattgagcaaccttgttcatcacttcacctcttggatcgttaactgcctataataatagacgttatttgcgttacgctttgcaaggctgcccacagagtctgtaaattcttgtcaggccgactcgcgtatccagcgcgtcagcgaggtacgatcgacatttaaccgtttcgccactaacgatttattatccctttccgcctctaataattttctcaaaatacgcaggcgaatcgttttataatcgccagccagcatctggcagtcgtggcaggtacttggctcgcgtcggctcccctcttccaaatcgtccagcaagaggcggccctcatccagagttgccggggagtgatcaatagagagcaccagccgttcgataatattgcttaactgcctgacgtttccgggccaggcgaagcgctgaagctcctgccacagcgccggggttaacgttagtgccgggcgtttataatgctggctgaaactagtaagcagcgacaggccgatggctttgatatcctccggacgtttgcgtagcgggatagtggttacttttaatacgttaagccgataataaagatcttcgcgaaatgtcccatccgcaatgagcttcgttaacgtctgattggtcgccgcaatcacgcgaatatcaacaggtatcatctggtctgagcccagccgcataatctgccgctcctgcaatacccgtaataagcgcgtctgtagcggtttatccagttcgctaatctcatccagaaaaatggtaccgtggtgcgctaattcaaacaggcctattttgcctttcggcgacgcgccggtaaatgcgccggcgacatagccaaagagttcgctctccagaatctgagtggccatcgcgccgcagttaatggcgacaaacaggccgttgacgcgttggctggcattatgaatactttgcgccagcacctcttttcccgtcccgctttcgccattaattaagatagtcgcgtccgtaccggcataatttttaatgatcgccagacgacgcagcatttccgggttttcggtaagcagatcgtcgaaatgatagcgggcgctcaagccgcggcgagacagttcctggcggcgaacatgatgttccgccccctgtaaactggagacggtttgcatcgtcaacaccacccggcttaactgtctggccgcaaataccggatacagattaactaccatcgcgccttgcggtgtatcgacgactttcgcgctgacggtttttccctcacgtaatgtatgccgctcctggtgcaatacctgtttcaggaaagatgcgtcataaatttcaccggaggcgttaattttaaaaagttggctcgcatatttattgtaatgcagtaacgcgccggtatcatcaagcgtgataacagctttatcaaactgatcgagaatcagctgcagatgatggcgctccagtaattggctgcgaaaagccagatataatgagcgggcttcttccagagcttcggttattgaggcggggctggaatcaagtaaacggaattgcgagcccagcggtgaaaaataatcctgacaaacggtatcgccaacaatgcaatctaatggcgtggacgctaattgccgcttcaggcaagaaatcgtttctttatcatttccctgtaaggtaaaaattttatagttaatatttaactgttccgctacgcgcgcgcatcctttgatcacactggaaaagccgacaataccgacagtgcctttttgtcctttaaaagggataagcgcatcaagaatgtcgtagccggacattttaatttcgactaccggtaatttactgtgcttttttaatatttccgcacagccgccacgactaatcagtacctggtgcccacgggactctaataaaggtagctcatccaggatacgattaagcgtcgtttgatgaatagtgacggcgtaatccaactgcgcgaccagcgcctcggcagcctttgccagttgcggataaggagagacaaaacagagaggagatgcggctatatctttcgtcttattcatcactcaccatcctgttggtttataaacgggcgagaccgcccgtcgtgatttattttccgccgaaacgctaaccgcctgcggcggctgggttcagtttacgatcgtagcgtttttttatccatacggtcaggaagggggcgcacagagcggtaataatcgtcgaggccgccacctgcgccgccgccgtcgacgccaggtcggtaaaatgcggatcgagcagcgcgattgccgctggcgtcgcgacggcgttgccagaggtggtggataccgccgcgcctgccacgccgctgcctcccgtcacacgatcggcgaaaatattaaaaaatccgccaatcgccaccgtcatgagtcccagtaaaatgcctgaagaacctgccgtgataagtcttgcgaaatcaatactgtatcctaacccaaaggcaaaaaagggaatcgttaccacgctgccctgtttaagaaacttgcgcatgtcctcatccagattgcccaaaatcatgccaatgataatgggaataataaccgccaccagattcataaagggtatcgacaccatgcctgccgatcctaacgccagcatggtgaaaaagggaccatcgttcaacgatattaccgcaatcgcgccgccgtcggtttcatcgccgtactcccccaccaacgcggcatataacccactgttcgagttggtcatcgccgaaataatcgctaaagccgacagacctaataacccatccgggccgcaaaatttcccgaccagaatgccaataatcacgccgctggcaaatttcgcaaaggtgatcgcagcgccttttttcaacgctttcggcgcggctttaaactggatatccgcgcccatacagactaaaaacatgcctaaaatcgccattgcgccatgcgaaatagagatgacaaaaccgcctatttccagcgcctccggcgcaaaagttttaaacaaggcgccgatgatcagcggtacaaccatcataccaccaggaaaacgttccagtgtttttttaattttcatagcttattcccaggagataaccggacagcttgtgctgcccgatttggtatcagaacgtcggcgcgatcttataaatagagaattcgttatgacctaaatcttctgatttagtcgttttcccattcgcgacgcgtaaaatttcctgataaatttcctcgcccatttgcgtaatagaagcctcgccagacataatggcggacacatcaatatcaatattgtcctgcatcatttcccacgttgctttattacccgtaatttttattaccggcgctattgggttaccggcaggcgttccgcgaccggtagtaaaaataacgatctgcgctccacccgccaccatgccggaaatagattcaatatcctgccctggggtatccataatccacaggcccggatgcgttggactatcggcatattccagtacgccctgtagcggcgcatgacccgctttatgcatacaacctaacgatttttcttcaatggtagtcagcccgcctttaatactgcccggcgtcggctgtcccccgcgaatatcctcgcccagcgcttttgctcgcgcctcacagccgaccactaaatcaatgagctgttgaccaacctccggcgtcaccgcgcgtttcgccatcacatgctcggcgccaataaattccgtcgtttcagaaagaattgagcttccgccgcagcgtatcagcttatccgaggcgaccccgcaggaagggttagacgccagccccgatgtcgtatctgacccgccgcactccatcgccagcagcagctcgctaaccggtgcttgctgcggtttttgcatggagagttgttgcgcatagtcgcgggccagcgaaatccccctggcctgacatttaagcgtgccgccctcttcctgaatggtaatgcaggaggtcggtttgccaaatgcggtaatctcttctgcgatgcgcagcggctccgcgccttcacagcctaagcccacaaccacaatagcgccgacgttgggattattcgccacattaatcaatgtcttttccgtcagacgcgcatcgcctgccacctggcagcagccaaaatcgttattcacccatgtcgcaccttttacctgccgggcaatatcctgggcaactttattcgcacaaacgctggtaggtaaaatcagtacataattacggatgccaaaacggccgtcagggcgtcggaaacccaaaaaagtctcattgctcataatcattttcccttgttttatattatttccagtcaccacgtccgcgttcgctttccacattgtggacgtgcacatagtcgccactttttatttcctgagtggcgcggccaatggattcgccatatttataaacttcgccatgaaaaggcacatcgcagatggcgaatttgtggccaaatggcacatcctgatgtaacacaacgcttatctcgcgttcgccaatgaacattgtggcggtttcgccggccttgagcgccgtaatagccgtcgcgacgcaatcctgagggtgaatcaccactgcattttttttcacgattaactcctttgctttagtcctgtcttccctaatcaaaaggcgtgccattttttaactgcatggtttatatgactttatttttacaggccgatctggcggtgacaggaactgcggtaatttgcctcagtcgtgtcgcattttgcgtcacctcctcatgaacgcctagcgcgacaaatgttctaccccctgttttgacgtgcgtgtttgggctatgctatgcggatctaaacaccacctctaaagctacatttgtagctgtatcgaaaacaggactactggctgccatgcaagagcaataccgcccggaagagatagaatccaaagtacagcttcactgggatgagaagcgcacatttgaagtgaccgaagacgagagcaaagagaagtattactgcctgtcgatgcttccctatccttctggccgactacacatgggccacgtacgtaactacaccatcggcgacgtggttgcccgctaccagcatatgctgggcaaaaacgtgctgcagccaatcggctgggacgccttcggcctgccggcggaaggcgcggcggtgaagaacaacaccgcgccggcgccgtggacgtacgacaacatcgcgtacatgaaaaaccagctcaaaacgctgggttttggctatgactggagccgtgaaatcgcgacctgcaccccggaatactaccgttgggaacagaaattcttcaccgagctgtataaaaaaggcctggtgtacaagaagacttctgccgttaactggtgcccgaacgatcagaccgttctcgccaacgaacaggtgatcgacggctgctgctggcgttgcgacaccaaagttgagcgtaaagagatcccacagtggtttatcaaaatcaccgcttacgcagacgagctgttgcgcgatctggataagctggaccactggcctgataccgtaaaaacgatgcagcgcaactggattggccgctctgaaggcgtggaaatcaccttcgatgtgaagggttacgataacacgctgaccgtctataccacccgtccggatacctttatgggcgccacctacctggcagtggccgccggtcatccgctggcgcaaaaagcggcggcgaacaacgccgagctggcggcgttcatcgacgaatgccgtaacaccaaagtggccgaagccgaaatggcgaccatggagaaaaaaggcgtcgacaccggctataaagcgattcatccgttaactggcgaagagatcccggtctgggcggcaaactttgtcctgatggagtacggcactggcgcggtgatggccgttccgggtcacgatcagcgcgactacgaatttgcctccaaatacggtttgaccatcaagccggtgattctggccgctgacggttccgagccggatctttccgaacaggcgctgaccgaaaaaggcgtgctgtttaactccggtgagttcgacggtctggcctttgaagcggcgtttaacgccattgccgataaactggcggaaaaaggcgtcggcgaacgtaaagtgaactaccgtctgcgtgactggggcgtttcccgtcagcgttactggggcgcgccgatcccgatggtcaccctggaagacggcaccgtgctgccgacgccggaagatcaactgccggttattttgccggaagacgtcgtcatggacggcatcaccagcccgatcaaggccgatcctgagtgggcgaaaaccaccgttaacggtatgccggcgctgcgtgaaaccgacaccttcgacacctttatggaatcgtcatggtactacgcgcgttacacctgcccgcagtatcaggaaggaatgctggattcgaaagcggcaaactactggctgccagtcgacatctacatcggcggtattgaacatgccatcatgcacctgctctacttccgcttcttccataagctgatgcgcgatgcgggcatggtcacctctgacgagccggctaaacagttgctgtgccagggcatggtactggcggatgcgttctattatgtcggcgagaacggcgagcgtaactgggtttcgccagttgacgctatcgtcgagcgcgatgaaaaaggccgcatcgtcaaagcaaaagacgcagcgggtcatgagctggtctacactggcatgagtaaaatgtccaagtcgaaaaataacggtatcgacccgcaggtaatggttgaacgttatggcgcggatacggtacgcctgtttatgatgttcgcttctccggcggatatgactctggaatggcaggagtccggcgtagaaggcgcaaaccgctttattaaacgcgtctggaagctggtttacgaacacaccgctaaaggtcctgtcgcggcgctgaacgtcgatgcgctgagcgaagatcaaaaagcgctgcgtcgcgatgtgcataaaaccattgccaaagtgaccgatgatatcggccgccgtcagacgttcaacaccgccattgcggcgatcatggagttgatgaacaaactggcgaaagccccgcaggaaggcgaacaagaccgcgcactgcttcaggaagcgctgcaggccgtcgtgcgtatgcttaacccgttcaccccgcacgtctgctttaccttgtggcaggaactgggtggcgaaggcgatatcgacaacgcgccgtggccggttgccgacgagcaggcaatggtggaaaacaccacgctggttgtcgtgcaggttaacggtaaagttcgcggtaagatcaccgttgcggtggatgccaccgaagaacaggtgcgtgaacgtgcaggccaggaacatctggtggcaaaatatcttgatggcgttaccgtgcgtaaagtgatttacgttccgggtaaactcctcaatctggttgttggctaagcgcgggaggaagcgtgcgatatctggtaacactgttgttatctctggcggtgctggtcaccgccggatgcggctggcatctgcgtagcactacgcaggttccggcttcaatgaaaacgatgatcctcgattccggcgatccgaacggtccgctaagtcgtgcggtacgtaatcagttacggctgaataacgtaaacctgcttgataaagacacaacgcgcaaagacgttccgtctctgcggcttggaacggtgactatttcgcaggatacggcgtcagtgttccaggacggccagacggcggaatatcagatggtgatgaccgtcaatgcctcggtattgattccgggccatgacatctatcctatcagcacgaaagtgtaccgttcgttcttcgataacccgcagatggcgttggcgaaggataacgagcaggccatgatcgttcaggagatgtacgacaaagccgctgaacagctgattcgtaagctggccagcgtccgcgcggcggatattcaggcgacgaaagaggaggctaccgccgacaatgagacggcggcgcccgcctctacgccagcacgcgtctccactacgctgagtaactaatgatcaggttgtatcctgaacaactccgcgcgcagctcaacgaagggctgcgtgcggcatatctattattgggcaacgatccgctgctgctgcaggaaagtcaggacgctattcgtctggcggctgcgtcgcaaggcttcgaagagcaccacgcttttactctcgatcccagtaccgactggggatcgcttttctcactctgccaggcgatgagcctgttcgccagccgccaaacgctggtgctgcaactgccggaaaacgggcctaacgcggcaatgaatgagcaactcgccaccctgagcgagctactgcatgacgacctgttattaatagtacgcggaaacaagctcaccaaagcgcaggaaaacgccgcctggtataccgcgctggcagatcgtagcgttcaggtcagttgtcagacgccggagcaggcgcagcttccccgctgggtggccgccagagcgaaagcacagaatttgcaactggatgacgccgcgaaccaactgctgtgctattgctatgagggcaatctgttggcgctggcgcaggcgctggaacggctgtcgctgctttggcctgacggtaagttaacgcttcctcgcgtggagcaggccgtcaatgacgccgcccactttacccctttccactgggtggatgcgttactgatggggaaaagcaaacgcgcgctgcatatcctgcaacagctacgccttgaaggcagcgaaccggttattctgctgcggaccctccagcgagagctgctgctactggtaaatctcaaacgtcagtccgcgcatacgccgttacgcgcgctgtttgataaacaccgggtctggcaaaaccgtcgccccatgatcggcgacgcgttgcagcgtctccatcctgcacagcttcgccaggccgtgcagttactgacgcgtacagaaattacgctcaaacaggattatggtcagtcggtatgggcagatcttgaagggctgtcgctcctgctctgccataaggcgctggcagacgtatttattgatgggtgatatgaaatcgttacaggctttattcggcggcacctttgatccggtgcattatggacatcttaaacctgttgaaacgttggcgaatctgatcggcttatcgcgggtgattattatgcctaacaatgtgccgccgcatcgcccccagccggaagcctccagcgcgcagcgtaaatatatgctggagctggctatcgccgataagccgctttttacgctgggtgaacgcgagctacagcgaaacgcgccctcttacactgcgcaaacgttgaaagcatggcgcgaagaacagggccccgaagcgccgctggcgtttattatcggccaggactcgctgcttaacttccccacctggcatgattacgacaccatccttgataacactcacctgatcgtttgtcgtcgtcccggctacccccttgaaatgacgcaggcgcaacaccagcagtggctggaacagcatctgacccatacgccagacgatctgcaccagttgccagccggtaaaatttacctggcggaaacgccatggcttaatatctccgcaaccctcatccgcgaacggctggaaaaaggcgaatcctgcgacgatctgttgccggaaaacgtgctgaactacatcaatcagcaggggttataccggtaagcacattgcgtagcgccgccagcagacgctcgttttgcgcagcgctgcgtatcgccacacgataatagcggctgtccagccccgggtagttagcgcagctacggattaaaatccgctgcgtcagcaaccgtcgctgcagatcaatatcctctcgctcacagcgtaacaacagatagtttgcccgcccgggataaaccgtcagcaggggaagctgacaaagcgcctgataaaaccgggcgccctcctcccgtaaccaatgccaggtcgcctgttgccaggcactatcctgtaacgctacctcaccggccagcgccgccagcgcgttaaccgaccacggcatttgttggcgacgcatccgcgccaccgccgcgtcatcgctattgacgagatatcccaaccgcaggccgggaatggcataaaatttggtcagcgaacgcagcacccagatatgcggattatctttaagagcaggaataaagcccgtctcatgcggaataaaatcgataaacgcttcatccaggatcaggttaatgttcagcgatttgcagcgatcggcaatggcctgtaataactgccgctccggcagcaggccggtaggattattgggcgtacacagaaacaggcagtccagatcgggcgtcaacgcctcaagaatggcatcggtaagctgccagccatccgcttcgcgtagagaccagcgacgaatttcacagccaatttgcgccagcgcccggccatactccgcgaaacctggcgtgacaattattgcacgacgcggtttaagaccgctcgccacggtaaagattgactccgtctcgccatttcccgccagtatccacgatgccggcacctggtgatgacgcgccagcgcctggtgcaaatgaaaataatcggcgtccgggtagcgctcaatgcagtccagattgtcgataagcgcgcgtttcacgctgacaggcatacccagcggattaatgtttgcgctaaaatccagtaactggtcaggcgagatgcccaacaccgtcgcggcttcccgaatattaccgccatgcgcgctgttgaataacgccattatgcctccggccaaaaaacgctattttagtgaaaaaaacgttgcgcaatcaggggcattatcatgttttgcgcatttaacctcatgaggaataccatgcgattgtggctggtgcgtcatggcgaaaccgaggccaatgtcgccgggttgtatagcggacatgctcccacgccgttaacggaaaaagggattggccaggcgaaaacgctacatactttattgcgccacgcgccatttgacagggtgttatgcagcgagctggagcgcgcgcgccataccgcccggctcgtactggagggccgggatacgccgcaacacatcttacctgagcttaatgagatgtacttcggcgactgggaaatgcgccatcaccgcgacctcacccatgaagatgccgaaagctatgccgcctggtgtacggactggcagaatgcggttccgaccaatggcgagggttttcaggcttttacccggcgcgtagagcgctttatctcgcgactcggcgcgttcagcgattgccagaacctgctgatcgtcagccatcagggcgtactcagcctgttgattgcccgcctgctcgcaatgcccgccgcctcgctatggcatttccgggtagaacagggatgctggagcacaatcgacatatgcgaagggttcgccaccctgaaagtattaaatagtcgtgccgtctggcggcctgagtgatgaattttccgttttttctcgccgcagcggtttcgcccattgacagcccccgacaggctgttattctccgcagccaggcttttttcaccttgcagagctttgcagaaattgttttacaaaaatggcgatgctttctgtgacgtgggatgggatgataatctggttttaaacgccgatccggcgacataagtcccggtatcgccgctgattcaggtatactacacggcgtcccgccggaaggttagcgttaactcgcaacgccttaccggtccagcctgttggccttttttctatcgttataacgcaattattcacccagggggaaaacttgcagggtaaagcactccaggattttgttatcgataaaattgatgacctgaaaggtcaggacatcatcgccttagatgttcagggtaaatccagtatcaccgactgtatgattatttgtaccggcacctccagccgtcacgttatgtctattgccgaccacgtggtgcagtcgtcgcgcgcggccggtatgctgccgttgggcgtcgaaggcgaaaatgcggctgactggattgtcgtcgatctgggcgatgtgattgtgcatgtcatgcaggaagaaagtcgccgcctgtatgaactggaaaaactctggagttaatgcgtgaagctgcaacttgtcgctgtcggcacgaagatgcccgactgggttcaaacgggatttacggaatatctgcgtcgttttccgaaagatatgccctttgagctgatcgaaatccctgcgggcaaacgcggcaagaacgcggatatcaaacgcattctcgacaaagagggcgagcagatgctggccgccgccggtaagaatcgcattgttaccctggatattccaggcaagccgtgggatacgccgcagttagccaatgagctggagcgctggaaacaggacgggcgcgacgtcagtttgctgattggcggcccggaaggattatctcccgcctgcaaagcggcagcggaacagagctggtcgctctcggcgttaacgctccctcacccgctggttcgggttctggtcgcggagagtttgtaccgggcgtggagcatcacaaccaaccacccttatcaccgtgagtgatcgtgaagtcttgagaagattaagcagcggatgaaacgacaaaattcttttcgtgactatacggctgagtccgcactgtttgtgcgtcgggcgctggtcgcctttttgggtattttgctgctgaccggcgtactgatcgccaatttgtataatctgcaaattctccgttttaccgattaccagacccgctcgaacgaaaaccgtatcaagctggtgccaattgcgccaagccgcgggataatctacgaccgcaacggcattccccttgcgctgaaccgcactatctatcagattgaaatgatgccggaaaaggtggataacgttcagcaaacgctggatgcactacgcagtgtggtcgatttaaacgacgacgatatcgccgcctttaaaaaagagcgcgcccgatcccatcgctttacttctattccggtgaaaacaaacctgacggaagttcaggtcgcgcgctttgctgtcaaccagtaccgttttccgggcgtcgaagtcaaaggctataaacgccgctattatccatacggatcggcgctgacccacgttatcggctacgtatcgaaaatcaatgataaagacgtcgagcgtctcgacagagaaaacaaactggcgaactacgccgccacccatgacatcggcaagctgggcattgagcgctactatgaagatattctgcatgggcaaaccggttatgaagaggttgaagtcaacaaccgcggccgcgttattcgccagcttaaagaggtgccgccgcaggccggacacgatatctacctgacgctggatctcaagctccagcagtatattgaaacgctgctggcaggcagtcgcgcggcggtgattgtcaccgatccgcgtaccggcggcgtgctatcgctggtctccatgccaagttacgaccctaaccttttcgtggacggcatctccagcaaagattactccgggctgcttaacgacccgaacacgccattagtgaaccgcgcgactcagggtgtctacccacccgcttctaccgttaagccttacgtcgccgtatcggcgttaagcgctggcgtcatcacccgtaacaccagtcttttcgaccctggctggtggcagttgccggggtctgagaaacgctaccgcgactggaaaaaatggggccacgggcatctgaatatcaccaaatcccttgaagagtcggcagataccttcttctatcaggtggcctatgacatggggatcgatcgcctgtcagaatggatgggtaagttcagctatggtcactataccggaattgatctcgcagaagagcgctctggtaatatgccgacccgcgagtggaaacagaaacgctttaaaaaaccgtggtatcagggcgatacgattccggtgggcatcggccagggctactggacggcaacgccgattcagatgagtaaggcgctgatgatccttattaacgacggtgtagttaaagtcccgcatctgttaatgagcaccgcggaaaacggtaaacaggtgccgtgggtacagccgcatgagccaccggtgggcgatattcactccggctactgggaaattgcgaaagatggcatgtatggcgtcgccaaccgccctaacggcacggcgcataaatattttgccagcgcgccctataaaatcgcggcgaagtcgggcaccgcgcaggtctttggcctgaaggccaacgaaacgtacaatgcgcataaaatcgccgagcgcctgcgcgaccataaattaatgaccgcctttgcgccgtataacaatccccaggtcgccgtcgcgatcatccttgaaaacggcggcgcaggcccggcagtaggcacgatcatgcgccaaatccttgatcacatcatgctgggcgacaacaacacccatttgcctgcggaaaacccggtggttgcagcggcggaggaccaataatcatgacggataatccgaacaaaaaaaccttctgggataaaattcatatcgatcccacgatgctactcattctgctggcgttactggtttatagcgcgttggtcatctggagcgccagcggccaggacatcggcatgatggagcgtaaaatcggtcagattgcgatggggctggtggttatggtggtgatggcgcagatcccgccgcgcgtgtatgaaggctgggcgccctatctctatatcatttgtatcattctgctggtcgccgttgatgccttcggcgcaatatccaagggcgcgcagcgctggctcgatctgggaatcgttcgctttcagccttcggaaatagccaaaatcgccgtgccgctgatggtcgcccgctttattaaccgcgacgtctgcccgccctcgctgaaaaataccgccatcgccctggtattaatctttatgcctaccctgctggtcgccgcccagccggacctggggacgtctattctggtcgccctttccggtctctttgtcctatttttgtctggcctgagctggcgcttaattggggtcgccattgtattgatcgctgcatttattcctattttgtggtttttcctgatgcacgattaccaacgccagcgcgtcatgatgctccttgatccggagaccgatccgctgggcgcgggctatcatattattcagtctaaaatcgccattggctcaggcggcctgcgcggtaaaggctggctccacggcacccagtcgcagctggagtttttacccgaacgccataccgactttattttcgcggtactggcggaagagctcggtctggtgggcatcctgattctgctcgcgctctatattttgctaataatgcgcggtctgtggattgccgccagagcgcaaactacatttggtcgcgtgatggctggcggattaatgttaatattattcgtttatgtcttcgtaaatattggtatggtgagcggtattctgcctgtggttggagtacctttacccttggtcagctacgggggctccgcactgattgtgctgatggccgggttcgggattgtgatgtcgatccacacccacagaaaaatgttgtcgaaaagcgtataaggggtgcgcaatgcataagcagttgcctgtaatctgcgtcgcggcagggatagtactactcgcggcatgtactaatgacggcggtcagcagcaaaccaccgtcgcgccgcaacctgcggtatgtaatggtccgactgtggaaatcagcggagcggaaccgcgttatgaacctctgaatccgaccgcaaaccaggattatcagcgtgacggtaaaagttataaaatcgttcaggacccgtcccgctttagccaggctggcctggccgctatttatgatgcggaacccggcagtaatttaaccgcctccggggagatgttcgatccgatgcagcttaccgccgcccatccgacactgcctatccccagctatgcgcgaatcaccaacctggccaacggtcgcatgatcgtcgtgcgtattaacgatcgcggcctctatggcaccgatcgggtcatctccctgtcccgcgcagcggcggatcgtctgaatacctcgaataatactaaagtacggattgaccccattatcgtggcgccggatggttcgctctccggcccggggatggcctgtacgacggtggcgaaacagacctacgctctgcccccgcgccctgatttaagcggcggcatgggaagcgcctcttcagcgcctgcgcaaccgcaaggcgacgttcttccggtcagtaattccacgttgaaaagtgacgataccaccggtgcgccggtgagcagcagcggcttcctcggcgcgccgaccacgctggcgcctggcgtgctggagggtaatgaaccgacgccggcgccacagacagcgccggtttccgcgccggtgacggctccagcgactgcgacgccggtgagcgcgcctgccgccgcagccccggtatctgccccggtgagcgcgcctgccgccgcggcgagcggtcgtttcgtcgtccaagtcggcgccgtcagcgatcaaacgcgtgcgcagcagtaccaacagcgtttaagccagcagttcagcgtaccaggacgcgtaatacaaaacggcgcggtctggcgtattcaactggggccttttgccagtaaagccgaagccagcgcgttacagcaacgtttgcaaacagaagcacaattacagtcctttatcgccagcgcgcagtaaccgattgcaggtatctgtactgtcaatttctgtaaatgacattaacaaagtcacgcggaaagtcagatgcctgccagttatgcttttgctatagtagggctcttttttaatttcatcacggacgtcgtagttcagaccatgaagaccactttttccgctcgttttatgcagcgcatggcgctcaccacggcgctttgtgccacgtttatctcaaccgcacatgccgatgacctgaatatcaaaactatgatcccgggtgttccgcagatcgatgcggaatcctacatcctgatcgactacaactccggcaaagttctggcggaacaaaacgccgacgaacgtcgcgacccggctagtctgacgaagatgatgaccagttacgtcatcggacaggcaatgaaagcgggtaaatttaaagaaaccgacctggttaccgtcggtaatgacgcctgggccaccggcaatccggtatttaaaggctcttcgctgatgttcctcaaaccgggaatgcaggtaccggtctctcagttgatacgcggcatcaatctgcaatccggcaatgacgcctgtgtggcgatggctgatttcgccgccggtagccaggatgctttcgtcgggctgatgaacagctatgtgaacgcgttggggctgaaaaatacccacttccagaccgtacacggcctggacgccgacggacaatacagttcagctcgcgatatggcgctgattggccaggcgttaattcgagatgtgccgaacgaatatgccgtttataaagaaaaagagttcacctttaacggcattcgccagttaaaccgtaacggtctgctgtgggataacagcctgaatgtggacggcatcaaaaccggccataccagcaaagcgggctataatctggtcgcttccgcaaccgaaggccagatgcgattgatttccgccgtaatgggcggacggacctataaaggccgtgaaacagaaagcaaaaaactgctgacgtggggcttccgtttctttgaaaccgttaatccgctgaaggctggtaaagagttcgcctctgaacccgcctggtttggtaataccgatcgcgcctcgctgggcgtcgataaagacgtttacctgacgatccctcgcggtcgcatgaaagatttgaaagcgagctatgtactgaataccgcagaactgcacgcgccgctgcagaaaaaccaggtggtcggcaccatcaacttccagctggacggtaaaaccatcgagcagcgtccgctggtcgtactgcaagagatcccggaagggaacttcttcggtaaaatcattgattacattaaattaatgttccatcactggtttggataaaaattgaacgcttgaaagtgtgattttcgtccccatatactatgcatcagtaaaactcccgccctgtggcgggagttgttatttttttacgtaatgccggagctgacatgaaaaccaaacttaacgaactgcttgaattccctacgccatttacttacaaagtaatggggcaggcgttacctgagctggttgatcaggtggttgaagtggtacagcgccatgcgcctggtgattactctccgacggtaaaaccgagcagcaaaggcaactaccactcggtctctatcaccattaatgccacccatattgaacaggttgaaacgttgtacgaagaactgggtaatattgatatcgtgcgaatggtattgtaatacatccagacggttacccggtcttatccgggtaactccccgcctcccccgctgtgatatactttcctctcttttttcattctctacggagatgccgttttgtatcaggataaaatccttgtccgccagctcggccttcagccctatgaagctatctctcaggccatgcataactttaccgatatgcgcgatgaaaacagccatgatgaaatctggttggttgagcattacccggtgtttacccagggccaggccggtaaagcggaacatatattgatgcctggcgatattcccgttgtgcagagcgatcgtggaggacaggtgacctatcatggtccgggccaacaggtaatgtacgttttacttaacctgaaacgacgtaaactgggcgtgcgtgatttagtcaccctacttgaacagaccgtggtgaatacgctggctgaaatgggtattgaggcgcatccgcgcgccgatgcgccgggcgtctacgtgggtgaaaagaaaatctgctcgctgggtttacgtatccgtcgcggctgctcattccacggtttagcgctaaacgttaacatggatctttctcctttcctacgcatcaacccgtgtggttatgccggcatggaaatggctaaaataacgcagtggaaggaagacgctaccacagataatattgcgccccgcttgctggcgaatattttagctctgctaaataatccaccgtatgaatatattgctacttaatgcgtaaaatataatggcccaagaaatttatgggtcattaatcatatatgatttgaatgctttacttctccccccgctttctatattttcgttatatccctgctgtagccgccaggcggcatggcctcttcagtcctcatgatgaggaattttccgtgaacaaaatcccggccttgctgttacttatcttattgaaatgactaaaaatacattcataagagtaattttaaaaccaactcataaatgcaaaatatactatttaatctattattcataatacgaatgaattcggagccagagcgtgagtgataataatcaggcagaaagacaaccggccgatcaacacctacaagacaaaccgcaaattttcagaacactgagaaatattgacctcaatctgttgacgattttcgaggccgtatatgtccataaagggatcgtcaatgcagcgaaaattcttaacctgacgccgtcagccatcagccagtccattcaaaaattacggactatatttcccgatccgctgtttattcgcaaaggccagggcgtaacgcccacgacgtatgctacgcatctgcacgaatacatcagccaggggctggaatctattcttggcgccctggatcttacgggcagctatgataagcaacgcaccattacaattggcacgacaccttcggtcggcgcgctagtgatgccgattatttaccaggccatcaggccgcgttatcctcagcttttgctgcgcaacattccggtagacgatgccgaaagccagcttagtcagtttcagaccgatctcattatcaatacccatagctataacaaccggagcatccagcatcacgtcctgtttagcgatacgcttgagattgtctgccgccagcatcacccgtgtctggcgaacgccattactgaagagagactgaacagcgcggatcacacctttctgatgctggagggacaacatctttccctcctgcgccagcgactgcaggagacatttcccgatcagcaaatcagttttagcagctacaatatttttaccattgcctcgctgatcgccagcagcgatctgctgggactgatgcccacccgcttctacgacttatttagccgttgctggccgcttgaacgccttccctacgcgccggtgaatagtgaacaggtcgagttctcgctgcattacaataaactgagtctgcgcgatccggtgctggagaacgtcattgatatcatccgtgaggcgttctgacaaaaatgttgcattcaggtcacggaagatatgggcaaacagcacaaaacaacaactattttacattttgccgggctgtcaggctgctttatggcccttatcaatgatatactgcgtgtcacaaattcaaaaatagttgataaatacaactttcccttgaattgaaacgctttccttcgttattcgcaactggaacacgcacgctatgagtaaacccattgtgatggaacgcggtgtaaaataccgcgatgccgataagatggctcttatcccggttaaaaatgtggtcacagagcgcgacgctctactacgtaaaccggaatggatgaaaataaaacttccggcggattctacccgtatccaaggcatcaaagccgcaatgcgcaaaaatggcctgcattctgtctgtgaggaagcgtcttgcccaaacctggctgaatgtttcaaccacggtaccgctacgtttatgatccttggcgccatttgcactcgccgctgtccgttctgtgatgtcgcccatggccgccccgttgcgccggatgcggaagagccgcagaaactggcgcaaacgatcgccgacatggcgctacgctatgtggtcatcacctctgtcgaccgtgacgatctgcgtgacggcggcgcccagcactttgctgactgcatcaccgccatccgcgccaaaagcccggagataaaaatagagaccctggtgccagacttccgtggacgtatggatcgcgcgctggatattcttaacgcgacgccgccggatgtgtttaaccacaacctggaaaacgtgccgcgtatttaccgccaggttcgtccgggcgccgattacaactggtcgctgaaattactggaacgcttcaaagaagcgcacccggaaattccgacaaaatcgggtctgatggtgggcttaggcgaaaccaatgcggaaatcattgaggttatgcgcgacttacgccgtcacggcgttaccatgctgacgcttggtcagtatctacagccaagccgccatcacctgccggtacagcgttatgtcagcccggaagagtttgacgagatgaaagcagaagccctggcgatgggctttacccatgccgcctgtggcccctttgtacgttcttcgtaccatgctgatctccaggccaaaggcatggaagtgaaatgatcgtgtaatagacgcttacatttcaggcaaaaaaaaaccggcaactcgccggtttttttactctgcggagcaagcgcattgcgctattactctttatgcgagagtttttcagcctgaacgctaccgtcgacgtctttcttaacgcccgcgtcttcatcgttcattgctttcttgaatcctttaatcgccgtgcccaagtctccgcccagcgtacgtaacttcttggtaccaaacagcagaacaaccagtgcggcaaccaccagcagtttggtaatactaatctcacccatagataccttcttcactaaaaacaggctgcgtaacgcgccggattaacctgagaatattaacggtctttcgacgcgcgcacacaatagcaatctgtaacaaggtgaatcaagctttgcgtaaaaaacatcataataattgcggtggcgcaaatcgtcgttgctgcaaaagaggaagttgctcccgcacctggtctattcgttctctgaatatttccgcgacgatcagcgccggacgatcggctgccgcggctatcgttacccccaacggtcgataatacgactttgaccaatattacgattaccacactccccggccgcaatcatatagcaggtggtatccagcgctctcgccgccagcagcgtcgaccactgctgctctttcaacgggccgcgaacccagcccgtcggcagcgccaatacgtcagccccctgtaaagccagcgctaacgccatatccggaaagcgcaggtcataacaggtcataagacccaccttaaccccctccacgtccagcacaggcgcgataacggttccggcatcaatactttgggattcttgcatcgaaaacgcatcatagagatgcagcttcgcgtaacgcgcgacaatgtgacccgcccgtagcgccaccagcatattaaccgcccgtccaggcgttgacgggacaaggatagtgaatatcgtcgtcatattattatgagcgctttcttccagaagccgcgtcataaacgcgccatccagcggctgcgcggcgcgaatcggcaggtcaaggtcgatgtcatctcgcgctaatatcccctcaggcaacaccagaagcgatacgccgcggcccgccgcctgagccattaacgaaacgcaaacttgcacattctcttcccatacagaactcaccacaaactgcccggctgcaacgaacatatcccctcccacacctctgtcaggactcgccaattatgcgtgttcggcgttacactcctcttgtatagcaattaaataaaggattcggcagtgttacagcttcttttagcagtttttattggcggtggaacggggagcgtagcccggtggatgctcagtatgcgttttaatccgcttcatcaggcgattcccatcggtacgctaacagcaaatttacttggcgcgtttattatcggcatggggttcgcctggtttaaccgcatgacacatatcgatccgatgtggaaagtgctcattacgaccggcttttgcggcggcctgacgaccttttctactttttctgccgaagtggtattcttgctgcaagaggggcgctttggctgggcgctgctgaatgtgctgattaacctgttgggttcgtttgccatgacggcgctggcattctggctattttccgccgccgcagcgcgttaagcgcaaaaaaaacccgccgaaagggcgggttttgaaatcttgctgtcggacgtatgcttacagagcagttacgtttgcagcggaagggcctttggcaccgttagtgatttcgaactctacgcgctgaccttcagccagagttttaaaaccattggtctggattgcagagaagtgtacaaacacgtctttgctgccatcttccggagtaatgaaaccgaatcctttggattcattaaaccacttaacgttacctttaatcttagacatcaaaattacctttacatgaaaaatagacacaaatgctgtatcggataccagtacaacaattgtgatgcattttgtccagtcgaactttgcgaaaaagtgataaatatcgcgttaatttttagctaaccctatctacttattgttttttaaggctttttaattcacaacagaacaatgcccttctccgtcaaaactggaaacgcatccaggcaaaatagacgtttccgttgttatacgaacccggaatgtaggtcatctgaaaggtagcgggaccatagcctatcgacgctaaaggcaacagcacagggatgggaatataattccagttgtcgcgcgcggtaacgcctgcggtaaagcccagtcccagacgaaaattatcgtcttccagcggtcgccaggttttttcccagccataaccgcctatgggttcccatttgttaaatgaatctttaaaggccatcatatagaggccatgccagttgcctttatcgtcccagcgcgactgaccaaaaccaacgccccacggccgttcgttatagcgatccgttttctctttatcgtaggcaaagcgcgcatgccaggtaatggcggggacatacaaatcataatactcaggctgtcgccacgtttctgcgacgttatcggtaaacgtgttaaaccaccctttatccgccgcagagactgaaggaatagccagccatggcataacaaggagagcaataataagaaaatactttctgatgatcatcgcaacatacataccgttcaaaaattcgactgtgataataacaacattaacctgaataaaatcttaacaaactataaacagagaataatctgagagagtatcgggttaacggcgtttgatttagcactcagaaccgtcacgcgctccttaataagctttcacaaaaaacacaaaacaaagcacaacaaataaaacaataaaataacaataaattaatacttatagcgctacagaaaatttgtataaacatatttcatctttagtgatgacatgaaaaaataaccgcgccgtgattttaatcagtaaggcgccatcctttattcggtacatttttataccacttttgtggttcttatttttactctgggtgtcgataagacaggggaaacaatgctaacagttatagagctccttatcggagtcgtcgttattgtgggtgtagcacgctacatcattaagggatattccgccactggcgttttatttgtcggcggtctggttctgcttattatcagcgcgctgatggggcataaggtattacctgccagcgaaaccagtaccggctataccgcaacagatattgttgaatacatcaaaattttgcttatgagtcgcggcggcgatcttggcatgatgatcatgatgctgtgcggctttgccgcctatatgacgcatatcggcgcaaatgatatggtcgtgaagctggcgtcgaaacctttacagtatataaactcgccctacctgttgatgattgccgcctattttgtcgcctgcctgatgtcgctggccgtctcttccgcgacggggcttggcgtactgctcatggctactctcttcccggtgatggtcaacgtcggcattagccgcggcgcggcggcggctatttgcgcttcgccggccgccatcatcctctcgccaacgtctggcgatgtggttttagccgcaaaagcggcggagatgccgttaatcgatttcgcgttcaaaaccacgctgccgatttccatcgccgccattatcggtatggcgattgcgcattttttctggcaacgctatctggataaaaaagagaacatttcacatgagatgctggacgtggcggagattaccaccacggccccggcgttttatgcccttttgccgttcacgcccattatcggcgtactgatttttgacggtaaatgggggccgcagttgcacattattaccattctggtcatctgtatgctgctggccgccgtgctggaattcgtgcgcggcttcaacacgcaaaatgtgttttccggcctggaagtggcttatcgcggcatggcggatgcgtttgccggcgttgtgatgctgctggtcgcggcgggcgttttcgcccaggggctgagcaccattggctttatccaaagtctgatctcgattgccacttcttttgggtccgccagcattattctgatgctggtcttagtgattttaaccatgctggccgcgatgaccaccggttcaggcaatgcgcctttttacgcctttgttgagatgatccctaaactggcgcactcctccggtatcaacccagcctatttatccatcccaatgctgcaagcctcaaacctggggcgcacgatttcgccggtctccggcgtcgtggtcgctgtcgccgggatggctaaaatatcaccgtttgaagtggtgaagcgcacgtccgttccggtcatcgtcggtctgttgatcgtcattatcgctacggaaattatggtgccaggcgcctcttccgccgtcaccggcggctgatagccggtaagccggggcgagggaaaacatcgctccggcatcttaaagcgggcttagccgccgtgataaatacgctgcggcctgcccactttgccatgaataatctctgcgacaatcaggtgccgactcgcgcaatattccaggtagcgtcgggatgtggtgcggcttatcgttaaggcctgcgcgaccgtttcagccgtatggcgtacggttggatcggcaaacagcttcatcaccgcattaagggttaaggcatcaatacctgtcggcaaatcccctttcggttcgccgcgcgcataggcgttgaacatttcatctatctgcttctggcttgcgctatccgcgctcgccagcatacgtctgcgctgttgataacgggtcagcgtctgccccaaacgctcataagcaataggtttgaccagataatcaaacgcgccgctacgtaccgcttccgctaccgtctccatgtcactggcggcggtcgtaaacacgacgccgccgggatagcgcgactgcattaattcatgcagcagcgtaatccccttcccatccggcagataattatccaacagaattaatccaggtttgaaccggtcaatcatcattctcgcctgcgccagattgcccgccagccatatctggttaaagccaggaatatggcggatatattctgcgtgcatttccgccagcagcgtttcatcctcaacgatcaatagggttaatggttctgtcatcgttttttttcactttcggaaggaataaagaaaataaggtgccacaaggatcattgtcttccagcgtaatgaccccgccacagcgccccacataacttgcaatcagatataacccgataccatgctcaccgggttcgtcagctcgggtacttacgccctgctcaaaaattttttcccgcagcgcttcaggaacgccgcagccctggtcggcgacctctatcaccacctcgtcgccctcgtcgctcaggaaaagttcgatggtattgtcgccttcctgtgtacgtaaactcgcctcaaacgcgttatccagcagattcccgacgatggcggcgaactccgtgctatccagcccctccggcagttgatgtaactggctgccgggaacaatcaccatcttgagccccagttcacgcgcgcgctgaactttgccaaacagcaaaccggccacctgacgatcggcgaaggcgccgcgtaaactatcaataagttgctgctgcgcctgcgattcgccctgcaccatctctctgacccgatcatactctttcatttgcagcaggccgttcagagtcgacatccagttcaggtgctcatggcgtagcgtgcgcaggctctcaacatactgtttaatctgggttagctgcgcgttcaacgtcgcgatttcatctttgctgcgaaaactaataatagcgcccagcagctcctcgccggaacggatagcctcacgattggcgatgacgctcaggccattgaagttggccatcacgtcctggcgtctttctgcgatctggcaggtaaaaaagtctgccggattgacgacttccgctatcagcttgcccagccactgacgccccggcgacggcagccccaacatttttctcgcattgcggttaatcgcggtgatatgtccctccggatcaacggcgatcagcccttcataaaccgagctaaataacgcctcctgctggcgtaccacgcgcgcaatctgtttcggctccatgcccagcatttgtcggcggatatgcgcggcgaaaaaccaggaaagcagcattaataccaccagcaacaggacaaaaacccccgccatcggtaataagaagtccagccgccaggagtcgattttactgaccagatagccaattgaaacaacgccgatcacgttgccttcgttgtcaaagataggcgttttggcgcgcatcgccatccctattgagcccttaccggtaatgaaataactttctcctctttccagcgcgccgggtttcgtaaactgcatgggatagccgattttttccggattcggatggtaaagccggatcgagtggcgatcgcctatcaccacatagtcaaaatccgtcccgcgctgcagtttattcgcaattatcgccaggcgtttatagtcccggttttttacggcagcgataatgctgtcgttagaagcaataatttttgcctgattcatcgccatgtcacgaacatgggacgccagataatcttcgaaactggcagacaaatattgtgctaacgctgccacgatgaaaacagaaaccaccagaatgagcagaaaaatacgtaacggaaacgcgagttgccgaaaaaaaggaaacagctttttatttttctgataggacattaaggttccttatgggtatttctctacagatttatcgcaaatgtaataaaaatgttttgagtatcttgaagcatataaaaaccaatcgttacagattccccacattaaatcaattaaacaactaaaacccactgccggaatggcgattaaattaattaaaaaacttaaaaccataaaacacttaaaaaccatctaacgctttgtgaaataaatcaaaatttaccaccaaaatactccttacgatgtatacgtcagagagaaaaataaataactcgtcataaaaatactcccactctgactgaaaagaaaaagttatcaagttgcaacacaacgcaacatatacagaaaagtggcaacaagcatatcaccaggatatttcttactatgtttggcaataatgtattcactcgggtaaaacgctctgaaaataaaaaatggcggagatcgctcactttctcaaagagaatgatttaagcgtcgataccactgtagaagtgtttattaccgtcagccgtgatgaccgtcttattgcctgcggcggtattgccggaaatatcattaaatgcgtggccattagcgaatcagtacgcggtgaaggcttagcgttaacgctggcgacggaattgattaatctcgcctgggaacggcactgcacccatctttttatttataccaaaacggaatacgaagcgctgtttaaacagtgcagcttttcgacgatagccagcgtccctggcgtgatggtcttaatggaaaatagcgcgacccggttgaaacggtatgcggaatcgctggcgacattgcgtcacgagggaaagaaaattggctgtattgtgatgaacgccaatcctttcacgcacggccatcgctatctgatccaacaggcggcggcacagtgcgactggctgcatctgttcctggtcaaagaagatacgtcacgctttccctatgaagaccgactcgatctggtccttaaagggactaccgatatcccgcgcttaaccgttcatcgcggctccgaatacattatttctcgtgcgacgttcccctgctatttcattaaagagcagagcgtcattaatcactgttataccgaaatcgacctgaagattttccgccagtatctggcgcccgcgcttggcatcacacaccgctttgtcggtacggagccgttttgtaccgttaccgcccagtacaaccttgatatgcgtttctggctggagacgccaacgcttcccgccccacccattacgctggtggaaatagagcggctttgcttccaggagacgccgatatccgcctcctgggtacgcaagctgctggttaaacacgatctcacggctatcgcgccgctggttcccgacgccaccctgcgctatttgcagggcatggtcgaacgccatccgggcagcgcggcagcccgtcaaaagtcccccgtattagcaacaggtgaaaaatgaaaataaaccagctagccgtcgcaggcacgcttgagtccggcgatgtgatgatacgcattgcgccgctcgatacgcaggatattgacctgcaaattaacagtagcgttgaaaaacagtttggcgaggccattcgcgccaccatcctggaggtgctttctcgctacgacgtgcgcggcgtacaactgaacgtcgatgataaaggcgctctggactgcattttgcgcgcccgactggaaacgctactggcgcgcgccagcggtattgccgctctgccctgggaggatcgccaatgatttccgcctctctgcaacaacgtaaaacccgcacccgccgcagtatgttattcgtaccgggcgccaacgcggcgatggtgaacaattcgtttatctacccggccgacgcgctgatgttcgacctggaagactccgttgcattacgcgaaaaagacgcggcgcgccgtctggtatatcacgcgctgcaacatccgctttaccgtgacgtcgaaaccatcgtccgcgtgaatgcgctggactccgaatggggcgtcaacgatctggaagcggtcgtgcgcggcggcgcggacgtggtgcgtttaccgaaaaccgacaccgcgcaggacgtcattgatatcgaaaacgaaattctgcgcattgaaaacgcctgcggtcgcgaaccgggcagtaccggcctgttagccgccgtggaatcgccgctgggtattacccgcgcggtagaaatcgcccacgcctctgaacggttgatcgggattgcgctgggcgcggaagactatgttcgcaacctgcgcaccgaacgctctccggaaggcaccgaactgctgttcgcccgctgcgccattttgcaggccgcgcgttccgccggcattcaggccttcgataccgtctattccgacgccaacaacgaagccggtttcctgcaagaagccgcccacattaaacagttgggctttgacggtaagtcactgatcaacccccgccagatagaactgctgcacaacctttatgcgccgacgcgtaaagaggtcgcccatgcgcgtctggtcgttgaggccgcagaagccgccgcccgcgaaggtctcggcgtcgtttcccttaacggcaagatggtcgacagcccggtgattgaacgcgcccgtctggtgctctcccgtgcagaactttccggtattcgcgaagaataaggcaaaaaaatgacgcagaaaaatgaatctcaacgccaggatcgcgtagtagcctggagccgtcacgctgaaagcgaactgagcgcttaccaaagtgcggcaaaattggatctacaagcgcaaaaaccgcgcgaccacaaactgtgcgccagcctggaagaggccatccgccgttccggtttacgcgacggcatgacgctttcctttcaccacgcttttcgcggcggcgatctgacgattaacctggtgatggaaaccatcgcgaagatgggcttcaaaaatctgaccctggcctccagctcgctgagcgactgccacgcgccgctggttgaacacattcgtaacggggtggtcagccgcatctacacgtcaggcctgcgcggcccgctggcggaagaaatttctcgcggcctgctggctgagccggttcagattcactcccacggcggtcgtgtgcatctggtacaaagcggcgaactcaatattgatgttgcgtttcttggcgtgccctcctgcgatgaattcggtaatgctaacggttataccggcaaagcctgttgcggttctctgggctacgcgatggtggatgccgacagcgcgaagcaggtcgtgatgctgacggagcaactgctgccgtatccgcataacccggcaagcatcgctcaggatcaggttgatctgatcgtgcaaatcgaagaagtcggtgatgcaaacaaaatcggcgctggcgcgacccgcatgaccactaatccgcgtgaactgctgatcgcccgcagcgcggcggaagtcattgctcactccggctacttcaacgaaggtttctccctgcaaaccggcaccggcggcgcatcgctggcggtcacccgcttcctggaagacaaaatgcgtagccgcaacattgtggctaatttcgcgctgggcggtatcaccgccaccatggtcaacctgcatgaaaagggcttaatccgcaaactgcttgacgtgcagagcttcgatcgtaacgctgcgcaatctttggcccgcaacccgaaccatatcgaaatcagcgctaaccagtacgccaactggggctctaaaggcgcttccgtcgaccgtctggacgtggtggtactgagcgcgctggaagtagacacccacttcaatgttaacgtgctgaccggctccgacggcgttctacgcggcgcgtccggcggtcactgcgataccgccgtcgcggcggcgctgtccatcatcgtcgcgccgctggtgcgcggtcgcatcccaacgctggttgataacgtcaccacctgcgtcacaccgggctccagcgttgacattctggtcaccgatcacggtatcgccgtcaatccggcgcgtccggagttggctgaacgcctgaaagcagcgggaatgaaagtggtatcgattgagtggctgcgcgaacgcgcgcaactgcttaccggtcagccccgccctatcgaattcaccgaccgcgtgattgctgtcgtgcgttatcgcgacggttcagtgatcgatgtggtgcatcaggtgaaggaataagccacgccactccactggtctcctttaccgtggtggcgccaggcccgatgaaagacagcgcgttaacccgccggatctttaatcacggcgtgactgccctgcacacgctggcagaagagtatggctggaccatccgggagcaggctgcactggcttccgccagcgggccggaagggttgctggcgattgacgcgcccgctcaggcgctcaaacaggcgaccatcgcgctggaacagcgttatccactggggcgcctgtgggatatcgatgtcctgacggcggaaggcgaaatactctctcgccgccatttcgcgcttcccgctcgccgctgtctgctgtgcgggcaaagcgcggctgaatgcgcgcggggtaaaacccacgcgctgactgatttactgactcatatggaggcgctgctgcatgatgccgattcccgtcaacccgactaacgcctccattcagcctcagtcgctgtatgacgcctgggccgatttggcctggcgcgccatgctgaccgaggtaaatttatcgccaaaacccggtctggtagaccgactaaactgcggcgcgcacaaagatatggcgctggcggattttcaccgcagcgcggaggcgattcgacactggctgccgcgctttatggaatatggcgccagctgcacgcgcctgccaccagagtcagttctggcgggcctgcgtccattggggatggcctgtgaagcagcgatgtttcgcgcaacggcgggcgtcaatacccataaaggcagcattttctcgctggggttactgtgcgccgccattggccgcctgtatcagctacgccagccgatcgccgcagaaacactctgcgctaccgccgccgatttttgccgcggcctgaccacgcgcgaactgcgccagaacaacctacagctcaccgcaggccagcggctgtatcagcaactgggattaaccggcgcgcgcggtgaagcggaagcgggctatccgctggtcatccgccacgcgttgccgcactaccgcgcattgctggcgcaggggcgcgatccggaactggcgctgcttgataccttactgctgctgatgtcgcttaacggcgataccaacgtcgcttcgcgcggcggggcggacggtctgcgctggttacagcagcaggcggcggtcttattacatcagggcggcatacggacgcctgatgatctcgtttatctccaccggttcgatcagcaatgcattgaacgcaatctcagcccaggcggtagcgccgatctgctgatcgtgacctggtttttagcgcaaatttcgcaagttaatcattaacacaattatagaaaatatcctttccggagagtcatttatgtctttatccaaagataatatatggaagttgttggccccattagtggtgatgggcgtcatgttgctaattcctgttccagatggtatgccgccgcaggcctggcactattttgcggttttcgtcgcgatgattgtcggtatgatcctggagccgatcccggcgacagcgatcagttttatcgccgtaaccatttgcgttatcggcagcaattacctgctatttgacgcttcagaactggccgatccggcgtttaaagccagtaaacaggcgctgaaatgggggcttgccggtttctccagcaccacggtctggctggttttcggcgcgtttattttcgcgctgggctacgaagtgaccggactggggcgccgcattgcgctgtttctggtaaaattcatgggtaaacgcacgctgacgctcggctatgcgattgtcattatcgatattttgctggcgccgtttactccctccaatacggctcgtaccggcgggactgtcttcccggttatcaagaacctgccgccgctgtttaaatcgtttccaaacgatccttccgcacgccgcatcggcggttatttgatgtggatgatggtgatcagtaccagcctgagctcttcgatgtttgtcactggcgcggcgccaaacgtgttaggtctggagttcgtcagcaagatcgccggggtccagattagctggctgcagtggtttctcagctttctgccggtagggattattttactgatcgttgcgccgtggctctcctatgtgctttataaacctgaagtgacccacagtgcggaagtcgcggcctgggctggcggcgagttaaaaaacatggggcgtctgtcccgcaaagagtggacgctgattggcctggtgctgcttagcttaggattgtgggtttttggtggaaaaatcatcaacgccactgccgtgggtctgctggccgtctcgctgatgctggcgctgcatgttgtgccgtggaaagatattacgcgctacaacagcgcctggaacaccctggtgaacctcgctacgctggtggtcatggccaatggcttaacccgctccggctttattgactggttcgccaataccatgagtacgcatctggaaggtttctcgccggatgcaaccgtcattgtactggtactggtactggtactggtactggtactggtactggtactggtactggtactggtactggtactggtactggtactggtattctatttcgcgcactatttgttcgccagtctttccgctcacaccgcgaccatgctgccggtcattctggcggtgggtaaaggcattccgggcgttccgatggaacaactgtgtattctgctggtgctgtctatcggtatcatgggctgtctgacgccgtatgccaccggccctggtgtgattatctacggctgcggttacgtgaaatccagagactactggcggcttggcgcaatctttggcgttatctatatcgcaatgctgttgctggtgggctggccgattctggcaatgtggaattaaacattacgccaacgtaggttaaaaatgatgccgttcaggttcacctgagcggcattttttatgattaaatgagtaacattcataatgtctataaattatcgaattcatcatgaacacaatatggcattacagtccgctgctggctgtcctcttaaccccgatttttgccgccaacgccgacgaacttcaggcgcaacagtacggtgatttcactgactatgtgctggcgctttcctggcaaaccggtttttgtcaaagccagcatgaacgccgccatcgggaacccgatgagtgccgtctgcaaaaagagccagccaacaaagcagactttctgaccgtccacggcctgtggccaggattacccaaatctatcgccgcacgcggtgttgaccagagacgctggcagcgctttggttgtgcgacgcggccaatcccgaatctgcctgaagtcaaggccagccggaaatgctccgcccccgcccccggactttcgcctgacatcgcgacagcgcttaaggaagtgatgcccggcgcgggggggaattcctgtctggagcgctacgaatatgccaaacatggcgcctgtttcgggtttgatcccaatgcctatttcggcaccatgatacggctggataaggcgataaaagacagcgcgctggggcagtttctggcggataattacggcaagaccgttagccgcgctgagtttgatagcgtcgtcgcacaaacgtggggccaggataatgtcaaagccgttaaagtaaactgccatggcaatcccgcctatttaacagagattcagttttcattaaaggcgtcgatgattaacgccccgctctcctctgcctcattccagccgcagccgcatcccggcaactgcgggaaacagtttattatcgataaagccggttattgacgaagcagaggtttaaaaccgtagccacatttgagaacacgcccgaatgtagactaaaattcactcagggctatgacgtttgaggatttacccgaatgtgaactaaatcacttcaaagacggggtaagtctcagtatcatcatgagagttaaaccctcgccgccagacggtgagggttttcttttgggaccatttacctgcactactcgcagtatcgatgacatggagtaagaaatgtccagacccactattatcattaacgaccttgacgccgaacgtattgatcgtcttctggaacagcctgcgtatgcggatctgccgattgccgacgcgctcaacgccgaactggatcgcgcgcaaatgtgttcgccacaagagatgccgaacgatgtcgtcaccatgaacagccgcgttaaattccgcaatttgagcgatggtgaaacacgcgtgcggacgctggtgtaccccgccaatatgacggacagcagtacccagctttcggtaatggcgcccgtcggcgcggcgttgctgggactgcgcgtcggcgacaccattcactgggaactgccgggcggcgcctccacccatctcgaagtgctggaactcgaatatcagcctgaagccgcgggcgacttcctgcgttaaaccatctgcataagcgttaatgcgtttacacagaggatgcctgcgcatcctctttccgttagctctttcatttctgcctgcttcagacaacgccgcctggcatcgggttgattactcccgtcgcctgtttctgcgccgcttgtgccgacatcgctcccggcaccaggataaccttccggcactcttcttcgcgtttttcgaaaatttcgtagccgcgcgccgcctcttcaaacggcatatagtgcgtgacaatctcctccggcttcagcaaccctttttcaataagcggtaataattcccccagccacgcgtgaacatgggtttgacccattttaaaagttagccccttatcaaaggcgtcgccgaataaaaagccgtgaataaaaccggcatacacgccgggcacgctgaccacgccgccgcgtcctaccgccgcgatacattgtcgcagcgctttgccgctgctgccttccagtttaaggttcgtcagcaccgtctccgtcatgctgcctttcgcttcaaagcctacggcatcaattaccgcgtccacgccgcggtgtcctgccgtctgctcgatgattttttccgccggatcgttctcatcatcgaagttgatcggtatcgcgccgtaacgttcttcggcgaaacgcaggcgccaggcgtggtgatcaacgacgaagatctgctccgcgcccagcagtcgcgcacaggcgatagtcagtaatcctaccggccctgcgccaaaaaccgccacgctggaacgttgctgaatctgggcattttttgccgcctgccaggcggtaggcaaaatatcagaaagaaacagcgctttatcgtcagataacagcggcggcaccttaaatggaccgacattaccttttggcacgcgaacatattcggcctgtccgccgggaacgccgccatacagatggctataaccaaacagcgccgccggcggcgggatctgttttttattcatcgccgcgccgtgtccgtcgttagtgttttcacacgctgaatattgctgtagtcgacagaaaaagcagtcgccacaagcaatgacgaacgggataacaacccgatcccctttccgaatattcttcacatcatgtccggtttccaccacctcgcccataaattcatggccgaaaatatcaccatgttttacctgtgggatcttgccgcgatagagatgcaaatcagatccgcaaatcgcggtggcggtaacacgcaaaatgatatcgtcaggctgctcaatgccgggatcgggtacgttttcaacctttacgtgatgtggaccgtgatacgtcaatgctttcatgcagcctccggggtaacggtgaatgttgcgttcgactataaaagggtagctatcccggagagactaccggaaaaacaggcggctttaggatttttcctggaaaatacacgacttttttaacgtcaggttgtcgcaatatttaaaattgccagacaaatagcagaaagaaacattattatatgcttgaataaattcagtattgattaacagggagtaacgggtatgtataagacaatcattatgccggttgatgtttttgaaatggaacttagcgataaagccattcgccacgctgagtttctggcgcaacaggatggcgtcattcatctgttgcatgtactgcctgggtccgcgagcatgagtctgcaccgctttgccgccgacgtgcgtcgctttgaagaacatttacagcatgaggcggaaacgcgtctgcaaacgatggtgggacacttcagtatcgatccttcacgaattaaaacgcatgttcgctttggtagcgtgcgcgatgtcgtcaatgagatgggcgaagaactggatgcggatgtcgtggtaatcggttcgcgtaatccgtctatcacgacacacctgttggggtctaacgcctcaagcgtggtgcgccatgcgacgctgccagtattggttgtgcgttaaccctggtggctaaaaactgacacgccctgccaggtcacgcctggcagggctttttactgcatcatcgttagtacaaatgcccgatattcacaatagtactcaccgtgtcgccaaaaaagaccagccgactcagaaatacgccaacgaataacaagacgaacaggagtttcgggcgcgaatcaccgtgacggctggcgacaaaagcgagcgcaaggcaaaccaggcttgccagataaaacggggaagccagccatgaacgcgccgtcatctgcatgaccgttcccccgcttaaccacaccagcggcgccgcgataagtaccgcgatacacaccacaattccctggcgtaacgcaggaacggcaggcctgagtcttaacagcggaatcgccgcgcaacccatgacccataccgtaataaaaaataacagcatggtaaatccattagcgatagctaccatcgctggcgcggcgtaggtcatcccctgcaccgccaccagtaacacgccgaacacggaggcgataagagccatcgctttatgtccctttgccaggaacgttacgccgaccgctgcgccaaacaacgtggcgccaaggatttcccgacttaaccaggcatgtcgcaggttaatcagcgcattataagcgcgatcgggatgcgccagatgcagaatcgcggcaatagacgccaatgccagcaccagcccggtggccaaccaatagaaacgctggccttccacttcaccacgcagcgtacgccatgtcagtaccaaagccatcccgacagacatctggcttaataccgtaaaaaacaccagcggcagttcatatttttccattacttgtcctccggctgcttaggctggcgcgccagaataaagcgcgttcctggattgagctgtggcatatgcgggaaccctggcggatactgcaccgcattatcgggcacaggatcggcatccaaatcgataatcgacaaggcgcccaccggacaggcgttcacgcacgccggattcataccgatatcaagacgctcgtagcatatactgcatttttccgctttacgcgtctcttcattaaaacgcggcgcgccataaggacagttacgaatacagtttttacagccgatgcagcgctcagggttatgcaccaccacgccatcttcacgtttggtataggcttcgaccggacaggcggcgacgcaggccggatgttcgcagtggttacaggccagcgagtaaaacgcccgctcttcatgtggatagatgtctttatccaacggataaacgtagcgccagaagcgatccggctccagttggttaaagcttttacacgccatagcacagccgcggcagccgatgcacttatcgctattcactaaaaacgcacgtctcatgctacggattcccctttaccgatcaatacaacgtcagcaaactgactgtggatagcggcgcccggcgcgccagttttcatcagccccatatcagcaggcgtatcggccacgacgttttgcacgttgtactgccgtttcgggaaccacgcttcatacatcaccagaaaatcttccggcacgttggtggtgacttttgcccgcagttccacctcgccaatgttgttgaaaactttgacccggtcattttcgctaatgccttttttcttcgcggaagaaggatggatataaacaaacggttccggatagaacacctgcatccagtccaggttgataaactgcgagtgcaggccaaactgcacgtgcggcgtaaacagatggaaaggcagtttgctctcggcttccggtttgtattccggcagcgcggtgtggccgtttttctccgccagttcagatttaaattcatacttgcctgacggcgttttgaacttgcgatcgtaccaggcggcagagcttggcaggatcgctttttttggcccgtccagcagatcgtcccaggaagagatgccgaacattttcgccataccgtcgttgaactcctgatccagccagcgcttgtgatcgaactcttgcgggaaggtacaggaacccggcgccatcttattaatggtgcgcgacagcatggtagcgatttcaaggtcgcattttgcttcatacatcggcttaatcgccggctgattaatggaaagccagtagtgccagtaagaagcatccacgttccactcttcaaacgcggtggtaacgggcagcacgatatcagcgtgttgcaccgtttcgttgaagaactgatcggcgcagaccaccatttccagtttttcaaacgcttttttcatcttgctgcgatcgaaatcctgggcaaacgggtttttacaggcgacccacagcatacgaaccggcggatcgttggcctccagaatcccctgcgccgtctggttaatattcagagagcgatcggagtactgcacggcgtcgctgccagcggcagccccgaattcactggtggtgcccgccgctcccggtatgccaatagcgcccaccggcggcttctgcagcatggcgttatagttaaagccccaggtatgcagatggccataacgcgcgccgccgccttcgacaccgatgttgccggacatagcgacaaaggcatcgatagcgcgaacgttggcgccgccgttgacatgacgctgcatcccgtaaccaatccaggccgtggccgggttaaccgccgtaaactcttccgccagttgacgaatcacctgtgccgacaacccgcagatttctgccgcccactccacggttacatggttacgcagataggcttcaaattccggatagccatgagcgtcgttgttgacaaaatcctgatccaccaggcccttatccaccagatggcgcgccatccccagcgccagcgcgccgtctgagccaggccgtacgcgcaggtagagatcggctttggcggcagtctgcgacagcagcgggtcgataaccacgaccttcgcccctttctcgcgcgcctgatagatatatttcatggagtgcattgagcaccaggctgggttcgcgccccagataatgatgtattttgctttcaccatatcttccgggtcgttacaccacatgtcgcccatgtcgtagttttgcgcgtcaataccggcaggccagcacggcgtaccggcaaaacgggtggtatagccaagcgaggacatcatcccttcaacggcatagttcagcacgccaaacttaccggaatatttggtcagcgccagaccgagcatagaactgtcttttttcttaatctccagcattttggcggcaatacgctgcatcgcctcttcccatgagatgcgacgccagttgccgctaccgcgaacgtcctgcgccatgggatatttaatacgatcgggactataaacccggcgcggatagctcaaccctttgacgtaaggcgtaccgtgagtaaatgttgattccggcgcaccttccacgaaagtaatgaccccgtcctttacccacgtcttgaggctacaggtgtcatagcagttacgcggacacgcgttacgataaattttgtacgttttagggttaaagggaacaggcggctgcgcaagcgcgcatcgggaggtcagtaatcctccgggtaaagccgcaacggtgcccagcgccactatcccctttaaaaaagaacgtctgttcagatgtcccgtctcattactcatattgatactctcgttttaattcatcaaaccaataaaataagatgtccgccaccgtatataacgtggtcgtttatgcatgagtttttattttttcgatatataatggcacccactttgttaaatagttattgatatattgagtgagggtagagcagtattgtgacgtttgccgggtattagccagtaatagtgtggtcaattccagcacgcaggaaatatgatcgtcaggaatattgctttcctgattaaccgataatcccaacgctgccataaaatcccgtatctccagcgtcgcctttcccatcaccagcgcatcctcttccagatacactgaagcgaaaggcgcagccagcagcttgccagggccgacgaatagcgcattaaagtcatactccgcttccagccacgcccggtcggtaaggtttaccgcagcagatggatttaatctcacgtaggcagatttcagtgaatgactatcatgagaattaaaaaaatcacgcaatgtaagccctgttttttctaattccgtcagtgattcatagattgaatccatgaataaataacctcacatacaaatgcaatataaatcaagaaaaaagaatgggcatgttaacggaagcgcttaatctttctttgataaaaaaacagaaaaattccagttaaatccgtagaagacttttttattgtttcaaagtttaaaaacagaagaccgttgaaataataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaccgtctgttattaacagacggtttcagagtattgataatgaagaacgtgttttacccggtggcgttccccaggcataaacaccgcaggcccgaatagcttacactatcgggccatttacgatggccagttaactggccttgcaggtgtgcttacttctttttatgcgattttggtgcgaatcagataatcaaaggcgctcaacgaggctttcgccccttcgcctgtggcgatgataatctgtttgtaaggaacggtggtgcaatcgcctgcggcgaagacgcccttaacgctggtttcacatttggcgtcaataatgatctcgcccatgcggttacgctcaagcacgccttccagccagtgggtattcggcaaaagaccaatctgcacaaaaattcctgccagcgcgacgctatgaatatcgccgctgacacggtcacgatactccagtcccaccactttcgaaccgtcgcccttcacttctgtcgtttgcgcattcaaaatgatatcgacatttttcaggctacgcactttgtcctgtagcacctgatccgccttcatctccggcgcgaactccagcaacgtaacatgttctacaatacctgccagatcgatagccgcttcgacgccggagttgccgccgccgatgaccgccacacgcttgcctttaaataacggaccgtcgcagtgcgggcaataggtgacgcctttggtgcgatactgatcctcgcccggcacattcatattgcgccatttcgcgccggtggcgatgatgatactgcgcgctttcaagactgcgccggacgccgtttcaatctgatgcaggccgccttctgtcgctgccggaaccagtttacttgcgctctggctgtcgataacgtcaacgtcgtaatcgctgacatgcgctttcagcgcgcccgccagtttctggccttcggttttcggcaccgagatatagttttcgatatccacggtatccagcacctgaccgccgaagcgctcgcccatcagaccggtacggatgcctttgcgcgccgagtagaccgccgccgccgcgcccgccgggccggagccgacaatcagcacgtcatacgcatcgcgtttgttcagcgcttccgccgcacgtttttctgcgccagtatccactttagcgacaatctcggtcagagtcatacgtccctggccgaactctttaccgttgacaaacaccgccggaacgcccatcacgttacgttcggtgatttcgttctggaaggtgccgccatcaattgccgtatgtttaatacgcgggttcagcaccgccatcaggttcagcgcctgcactacgtccgggcagttatggcaggagagtgaataataagtttcgaattcaaaatcgccgtcaatatcgcgaatctgctccagcagcgactgcgcttcttttgacggatgaccgccggtccacagcaacgccaaaaccagcgaggtaaattcgtggcccagcggagaaccggcaaagcgcggcccctgctgagagcctggattcgtaatcaggaaagacggcttgcgcaccggcagagtattgtcttctttaaatgtgactttgtcggacagctcggcgatttcagccagcagttccttgatttccgccgatttagcgctgtcatccagcgtggcaatcagctcaacaggtttggtcagtttctcaaggtaagccctgagctgggttttcatatttgtgtcgagcattcttcttccctctctgaaaacatcatcatgcaagccgacttcgcgggactgcattaatgcaacttgcgtcatggtgctgaaatgaaatgggcgcggatgcgcccatgactgaaacaatttccaaagtatttcacgtcagagtaaggcggctagcctgagaatccccgggagcttactgaagtaagtgaccggggtgagcaggcaacgccaacgcagctatggcgtgaaagacgacggaaatttagattttaccgaccaggtctaaggatggagccagagtcgcttcaccttctttccatttcgccgggcatacttcgcctgggtgagcggcaacatactgtgctgctttaattttacgcagcaggtcagacgcgtcacggccgataccttcagcggtaacttcgatcgcctgaatgataccctgcgggtcaacaacaaaggtcgcacggtctgccaggccttcatcttcacgcatgttgtcgaagttacgggtcagggcgccagtcgggtcgccgatcatcgcatatttgatttttgcgatagtttcagagctgctgtgccatgctttgtgcgtaaagtgagtatcggttgagacggaataaacgtctacgcccagcttctgcagttcttcgtaatggtcggcaacgtcacccagttcagtcgggcaaacaaaggtaaaatcggccgggtagaagaagaagacgctccagcggccttcggtatctttctcggtgacttcaatgaattcaccgtttttgaacgcctggtttttgaaaggtttgattttggtgttaattaaggacatctatacttcctccgtgttttcgttgaggagtaagttaacgaaattttgctgattcggctaatgcgtttccattatcaaatcaataagcgttaactaacaacccgattcgggcgacattgtgaacactgcgccctgtcagccatctaaagtaaaaaggccgcctgacaggcggccccattacctgaactacccgtaggtaacttcagagccagtacgactcgtcttgcaaatggcaggcgtattgcctgccactcgaaatccatagcgtatatgctggctaagtgttgcgctctacattaccttaacaaaggctgtaacagcgaaaaggattacatcaccccagcacagaaagggcaatcctggcacgccagctcttacctatgtctgcgataggcatcatcattaatactcttttcgctttgatattaaaaagaaaaatatgattaaacgtacattgctgcttgctatgctgcccattctcgcccacgcggaagaactgcctgcgctggttaaagccattgaaaaacagagcataacaatcctgaaatccttcgaggcgccggggggcatgaagggctatctcggaaagtatcaggatatgggcgtcacgatttacctgacgccggacggtaaacacgcgatttccggctatatgtataatgaaaaaggtgaaaatcttagcaacgccctgatagaaaaagagatctatgcgccagccggacgtgaaatgtggcagaaaatggaaaaagcgtcatggatactcgacggtaaaaaagacgcgccggtggtgctgtatgtctttgccgatcctttctgcccctattgtaagcagttttggcaacaagctcgtccgtgggtcgaatccggcaaggtacaattacgcacattactggtcggcgtgattaaaccggaaagcccggccacagccgcagcgattttagccgcgaaaaacccggcgaaaacctggcatgactatgaagcctccgcaggaaagatgaagctggaggttcctgcgtccatccccccggcgcagatgaaagtcattaatcagaatcagcagttaatggacgatcttggcgctaacgcgacgccagcaatttattacatgaataaagataagattttgcaacaggttgttggtttaccggaaaaagcgcaactggacgccatgatggggcagccttaacgcagaaattagcaaggcagaagcttaaccgtaccacgcccgacagcgctacgtttgtcgggccaaccacctcccggtattaacgcgacgccagaccaaaatgtcatccggcacagcctttttaggctaacggcgtgattatatcagggtacgttatgtccgcctttaccgtaattatttactcgctaaaatattcataactgtggtattttagtttaaataaactctacattaagtttaataaacataattctggtaaattattgagattaagtcataatcatggaagataccatgataatgccgggaagatactatggctaacctttacgaccttaaaaaatttgatcttaacctgttggttatatttgaatgtatttatcaacatttaagcattagcaaagcagcggaaacactctatattacaccttctgccgtcagtcagtcattgcaacgcctgcgcacgcaattcaatgatcctctatttattcgctcaggcaaaggaattacgcctaccgtaacaggcattaatttacattatcatttagaaaataaccttaacagcctggaacaaactattaatataatgaatcagtccagtctgaagaaaaaatttattatctacagcccacagctgttgatcacccaatatgcgatgaaattagttaaatatatccgcaaagatccacaggttgaaattgaacatcacgacattttgaccactgacgaactgcctgaagatctgcttgcctaccgcaaagcagatgttgtggtttcaatggccccacttaataatcgttctattgtttgtactcactttaataggctagaatgtatcctggtttgcagtgaaaatcatccccgactaggcgacaccgccactatcgatgaaattctacaagagtcatttacgcaactcgtctcccgggcaaccggtatgaaagagtatcattcacttatagatgatgtgctgggggagagaataattggtttaagaagcaaatcggtgatgactatcgccaactccatcagctccacggagcttattggttttttaccacaaacatttgttgactattactcttcctctatcaaacttaaaaaagtcgccacaccttttaccattgctcctatacaattctatcttatgtacaatagagcttcgctgaataatagcggatttgctgagctcattgagtacatcacaaaaaagcgttaataaggagatcagagaacgagtaataatataaattaagtgtatacattcgtagaatgtatttacttagagaatataataagacattgcaagttcatataatcagattatcctttatgttaattattgcgaatatattgtagttaacacattggagactatccagagatgtcggtttataaagttccgcttgagcaaaatgttctggaagcggctcaagagcgtataacatggcccctggaaactttaccccgggtctgcgtctcattttctggtggtaaagattcaggacttatgctgcacctgacggcaacgttggcgcgcaaaatgaataaaaagatccacgttcttttcattgactgggaagcgcaattctcctgtactatcgcttatattgaatcgttacgtgaatactacgcggacgttattgagcgtttttattgggtcgcattacccttaaccacacaaaattccctttcacaataccagccggagtggcagtgttggcagccgggaaccgactgggtacgacaaccgccagaagatgcgattaccgatccggcctttttttccttttatcaacacggcatgacttttgaacagttcgttcgcgattttgccgactggttttcagaaaagcgccctgccgctatgctggtcggtattcgttccgacgaatcctataaccggtttgtcgctatcgctaactcgcataagctgcgctttgccgacgataagccctggaccacgttggcccccaaggggcacacctggtatatctaccccatctatgactggaaaaccgcagatatctggacctggttcgccaaaacaggtaaatcatgtaaccccttgtataatttgatgtatcaggctggcgtaccggtccgttacatgcgtatttgcgaaccattcggcccggaacaacggcaggggttatggctgtatcatgttatcgaacctgagcgctgggcggccatgtacgccagagtcagcggcgtactcagcggaggaatatacgccgggcaggacagccatttttacggccaccggaaaattttaaaacccgatcaccttaactgggaggagtacgcgctgctcctgctacacagtatgcctgaagtcactgccgaacattaccgtaataaaatcgccgtttatttgcagtggtataagaaaaaaggcatgaacaccattccacagacgcagcagggcgatatcggatcgcgggatattccgtcatggcgacggatctgcaaagtattactgaacaatgattactggtgccgggcgctgtcattcagtccgacaaaacctaagagttaccagcgttataacgaacgcatgaaagctaaacgccaggaatgggggatcttatgcaacaccgactcacaaccgaaataactcactttctctctggactgcctgaagaggaaaggatcgccgccattaatgaatttagaagggcgatacataacgttagtccttttcgcgatgagccagtcgattgtgtcctgtgggtgaaaaacgatcatatttcgcctaatgactacaacccgaataacgttgcgccaccggagaaaaaattgctgcttaaatcgattgaaaaagatggctttactcagccgattgtggtggtaaaggccaatacggaggaatacgagattgtagacggctttcaccgtcatgagttgggcaaaggaaaagcggtcctgaaaaggcgcctgaaaggttatctgccggtagcgtgtctggacagagaacgtcacgaacggatggcggcaaccatccggcataaccgcgcgcgcggacgccaccagatccacgccatgtccgaaatcgtacgcgaactttctcagctaggctgggacgagagcaaaatcggacaggagttaggtatggacgccgatgaagtcctgcgcctgaaacagatcaacggactgcaggaactctttgcagaccgtcgattctccagagcgtggacggttaaataactacagtttacacaggcgctctgcggcggccagcagcgttgattcctgtttagcgaaacataaacgtataagctgatgcgggaaaggggcggcgcaaaagacagagagcggaatagcggcgacaccgacttcttcggttagccactgacaaaactcaacgtcatttagcgtcgacactgcgctgtaatcgattaacaaaaaataggtaccttcacagggcagcacttttaatcggctttgcgccagcgcgttaaccagcacatcgcgttttttccggtaaaaatcgggtaacgcgcgatagtgttccggcgcggcgcgcagcatatccgccagcgccagttgcgccggcgtattgacgcaaaacgtcaggtactggtgaactttgcgtatttcggcgctaatggccgcaggcgcaacgcagtaaccaatcttccatcccgtcatatgaaaggttttaccaaacgatgaaacggcaaccgcccgctctcgtaactgagggtgcgccagtacgctggcatgaccttcggcggcaaaacaaatatgctcgtacacttcatcgcttaatacataaatttcccgctcgccgatagcctgccacagcgcctcgatatccgcctgacgccagacggtagcggtgggattatgcggcgtattgaggatcaccagccgcgtgcgctcgctaagcaacgccgaaaacgcctgccagtcgacgcgaaaatgcggcggcgtaagcgctatgcgttttaacacgccgccggaaagcgccacggccggggcatagctgtcgtaactgggatcgaaacagataacctcatcccctgcccgcaccagcgcggtaatcgccgcatacagcgcttctgtcgcgcccgccgtgacggtgatatcacttacgtcatcgggtcgataaccatatatttccgccgttttatcggctatggcctcccgcagcgcctgcgcgcccgtcatcggcgcatattgattcgcgccctgcgcgacatgataagccaaccgctcgtgcaaataagaaggaccatcaaaatcagggaagccttgcgataaatttattgcctgatgtttctgcgccagcgcgctcatttgcgtaaaaatcgtggtgccaagattgggcaatttgctctttggaatcagtgggttatttctcattatcttcatacccgccagtgatgtggttgttgacacactatcacagggtgttagtatttggcaatcaagacgtttagatgtctaaatataataacagcggtgagaagaccctaaggacaacacaacatgaaccacactgagatccgcgtcgttaccggcccggcgaattatttttcccatgcaggaagcctcgaaagactgaccgactttttcacgccggaacagctttcccacgctgtttgggtgtacggcgaacgcgcgattgccgccgcccggccttacctgccggaagcgtttgaacgtgctggcgcaaaacatctgcagtttaccggccattgtagcgaacgccatgttgcccaactggcgcacgcctgcaacgacgatcgtcaggtggtaataggcgtcggcggcggcgcgctgctcgataccgccaaagcgcacgcccgccgtctggcgctgccgtttgtcgctatcccgacgatcgcggcgacctgcgccgcctggacaccgctttccgtctggtataacgacgcgggacaggcgttacagttcgaaatttttgatgatgccaattttctggtgctggtcgaaccgcgcattattctgcaggcgcccgatgactatctgttagctggcattggcgatacgctggcgaaatggtatgaagccgttgtgcttgcgccgcagcctgaaacgttgccattgaccgtaaggctgggcattaacagcgcgtgcgctattcgcgatctcctactgaccagcagcgaacaagcattagcggataaacagcagcgtcggctgacccaggcattttgcgacgtggtggatgcgattattgctggcggcggtatggtcggcggcctcggggaacgctatacccgtgtcgccgccgcccatgcggtacacaacggtctgaccgtcctgccgcaaacggaaaaattcctgcacggaacgaaagtggcttatggcattctggtgcaaagcgcgctactgggacaagatgacgtgctggcgcaattgattacagcgtaccggcgatttcatctgccgacccggcttagcgaactggacgtggatattcataacaccgcagagatcgatagggtcatcgcgcataccctgcgcccggtcgaatctatccactatttaccggtgacgttaacgccagacaccctgcgtgcggcgtttgaaaaagttgaatttttcagaatatagcctggtggcgttgcgcttgtcagacctggcaaccatcagcagcaacgcgcgccgccttttccaccatagcgcgcatcctgccgctcgcggaaaaattcttcataggtcatcggcgtctgatccggatgcgttatgcgcatatgttccacatagttgtcgtagtctggcacgccaatcatcatttttgctgcctgtcccagatattttccggctttcgaaagcgtatcgaacatcgttgtcacctgtcatccaaacgccctctccttattctggagagggctattgatgaaaaaagattagtgcgcgcctttcgcttgcgtcacgatctcatccacattttccggcatcggctcatacggcgtttcattcgccgtcggtttatcaatcttcagagcggccagcgccgtcttaatagagaagaccgccagcaccacgaccaccaccataaagaagatggttagcccggcatccagacggttattgaataccaactgcgcgagctgcgattcggtgtactgcggcggaatattgccgctgtcgatcatcgcctggaatttattggcaatggccaggaagccgattttcgcatccggactaaacgctttctgccagcccgccgtcagcgtacaaatcagcagccaggccgtcggcaccagcgcgacccacgcataacgctgacgcttcattttgaaaagtaccacggcgcaaagcatcagcgccatccccgccagcatctggttggcgatgccaaacagcggccacagggtgttaataccgcccaacggatcgaccacgccctgatggaggaaatacccccacgccagcacgcacaatgccgtagcaagcaggttcgctggcagcgaatcggtacgtttcagccctggcgacactacgcccaacaaatcctgcaacataaagcgcgccgcacgggtacccgcatccaccgccgtcagaataaacagcgcttcaaacagaatggcgaagtgataccagaacgccacatccatcatgccgcccaacgcgccatgtaaaatgtaggccatccctaccgccagcgttggcgcaccacctgcgcgggagataatggattgttcgccgacttcattggcaatctggtgtaacgtatccggcgtgatagcgaacccccaactactgaccacctgcgcggcagaagctacgacatccgctgtccccgctggcgccagtaccgccatcgggctattcatcgcaaagtaaacgcccggatcgataatacaggcggagaccagcgccataatggcgacgaaagattccattaacatcccgccgtagccgataaagcaggcctggccttcgttggccaacatcttcggcgtcgtgccggaggagatgagcgcatggaaaccggataccgcgccgcaggcgatggtaataaacaggaacgggaacaggtcgcccgtccagacgggtccggtaccatcaacaaatttggtcagcgccggcatggtcagcgtcggacgcataatcagaatcccgactgccagaccgacaatcgtaccaattttcaggaaggtagagaggtaatcacgcggcgcgagcagcagccagaccggcagtaccgccgcgacaaaaccataacccaccagcatccaggtaagctgcacgccagtaaaatcaaagtacggcgcccaggttgggcttgccgccacccatcccccggaaataatagcgaaaataagaaataccagcccaatgaccgacacctcgccgatgcgccccggacgcagataacgcagatagatgcccataaaaatcgccagtggaatagtgaacgcgacagtgtacgttccccacgggctatgggtcagcgctttcaccacgatcatcgccaggacggccagaatgatcaccatgatcataaagcaggctaccagcacgatcacccctgccgtcgcgcccatctcctctttaaccagctcgccaagcgaacgcccatcgcgccgggtcgagacgaacagcaccataaagtcctgcaccgctcccgccagcacgacgcccgccagcagccagatcatccccggcagatagcccatctgcgccgccagtaccggcccgaccagcggacctgcgccagcaatggccgcaaaatggtgaccgaacagcacttttttatcggtcgggacataatccagaccatcattatgacgtaccgcgggcgtcatacgcgttgggtcaaccgccagcacttttttggcgatatagagcccataaaaacgatacgcaataagatagacacagaccgacgccaccacgatccatagcgcgttgatctgttccccacgatttaacgcaatatagcctagggcaaacgcacccaatactgagagcgctgtccagacgaggtatttccctgatttattcatagttgttgtccgtttgggtgttccagagagatgttacattttgtttctatgacacctttaccgtaattaacaacacaacaacatgataaaaccggattgttacccattttttacattacagtgttaaccagatcacttcctttcttcgttaatgctgcaattgcattttactttgccagaactatcccattaccgccgttcccaggcgacaagtgcagcagcgcctcccctgctcgtcaaagagcgtaatttcccagctttgattctgccgccccagatgcagcggcaggcaaacgccgcgtactttcccctgcgagacggcgcggtgatgggtggcgtttaactcggtcccgaccacgcactgcccgtcgcgggtcatcagataacccgccattgatcctaacgtctccgccagcgctgccgatgcgccgccatgtagcagaccaaacggttgatgagtgcgggcatcgacgggcatttccgcctccagcacgtcatcgcccagacgggtgtaaacaatgcccagatgcgccaccagcgtgttctgactggtagcattcaattcatccagcgttaaatgccgtttccagatcatcgtcaggctcccaatgttgaaccgccgtccaccacgatatcctgcaaggtaatgtggctggccagatcggaggcaagaaacaaaatggtattggctatctcctgcggacgggcgattttaccgagcggtatgccgagcttaaactgttcgccgaaaccgcgaatgcgctgctgttcggcatcttcactcacccataacgtgcgctgcatatcggtgtcggtcgagcccggcgacaccacattacagcgtaccccgcagcccgccagctccagccctacggttagcgccaggcttttcagcgccgctttagaggcgccgtaagcgcccataccgatacgcggcgtatgcgccgcatctgaggctacggtgacaatcgcccctccctgctgacggcgaaactgcgccatcgtctgggaaaacaggttaaatgccccgcccacattgaccgcaaatgtctgctgccagtcgtcgacgttaagcgcgtcggtcgctcccatacgcaaaataccggcggcgttgaccagcacatccagccgcggcgttttttgcaacacacgctggcacacctgcgcaacctgtgcggcatccgccacatccataacttcggtagcaaagggataattctcttgcgtaaattcgcgatcgaagccgatcacccgcgccccggcgtcgacaaacgccagcgccgtcgcgtaaccgatccctttccccgccccggtcacccataccgttttgtctgaaaaatcaaagctggccattactctaccccgcgagaaagcagcgcccaccaggcgtcaatggtcggatttttcgccagcatcacgaagtcgatatcgccgtgtactttacgccagcgcgccgccagccccatcatgcgtactgaatccaggccataatcaatcaggttttcatcatccagcggctcgtcggtctcatccagtaacggcagaatcaacgcccgcagcgccgctttactggcaggaatcggcgtcggcagcagcgactctgtcatgacgacgcgaccggaacgccccgccacatagttcagcgccatcagatgctcttcccgactgaaatccgccagcgcatccgccaccataaacggcttaatgtcgcgcataaacgcatcggtagcggtggtcatacagccaatatgtgcatatacgccggtaatgatgagctgattgcgtccggtatcttttaacatctgttccagcggcgagcggtgaaacgcgctataacgccacttcaccagcaccgtatccgcctcatccggcgttaaggcttctaccaccttctgctgttccggagagcgcgtcagtcccggtccccacatatcattgagtaacgcgcgatcttcatcgctttgctctttcggctgagcggtgtaataaaccgggatatgatgttccttacagtactggcgcagagcggcgatattggcaattacctggtccatcattgggcaattgcggccccaaaagctgacaaagtaatcctgcatatcgtggatgagcagcgccgcgcgctccggctcaaatgcccagttcactttgttggtcgggatatccagtgcggtgggcagcgcgtaagactgtagtttcgggattgccatctctctttctccttcagagcggtgaacgtgacgccaaccgctggcgtaattgttttttatcgactttaccaaccggcgtcagcggcagtgacgcaacgcactccacgcgatccggtaatttaaattccgccacgccctgctctcgcaggaaacggcgtacctgtaccgctcgcagcggctcttttaccaccagatatgcgcaacttttttcccccagcagttcatcttccatgctgaccagcgccgcatggatcaccgccgggtggcgcagtaacaggttttctatctcttcggcggctatcttctcgccgccccggttgatctgatctttttcacgcccgtgaacggtgatgtagccgtcttgatcaatggagatcagatcgccggaacagtaaaaaccgttggcgtcaaaggcgctgacattgtgttgcggactgttgaaatagccgcgaaaagtataggggccgcgcgtcatcagacgaccaatctcgcccggcggcagtggattcccgtcggcatccgccacccacacttcgtcgtccggacacatgggtcttccctgggtattgataatccgttccgggctatcgtccagccgggtatagttcactaacccttccgccatgccgaagacctgctgcaactgacagccaatttcagccggaatacgggcggccagcgtcgcagaaagccgcgcgccgccaacctgcaataaccttaatgacgccagcggcgcattgccgccccactcctggatagcctgtagccatagactgaccgcgggcggcaccagcgccgtggcattaatctggtgtttttcgatcagcgggaaacagagcgtggcgccaggatcggtcgccagcactaccgttcctttggcgagaaaaacgcccagcgcgcccggcgaactcatggcgtagttatgcgcggcgggaatcgcgcacagaaaacgcgtctcctcgttgaaaccgcaaatctcattgctgcggcgcacgctgtagtaatagtcgttatgggtacggggaataagctttggcgtgccggtagtaccgccggaaagctgaaagtaggccacttcgtcagcaggtgatggcgtggcggtgaaaccttccgccgcctgccgcatcgccgcgtccaggctgtgatcgccgtcgtcgttgcgcaataacaccacccgcgcagagcggtgttcagccacaaacctgttgagaaagtcctccccggcgaacagcgtatgttggcgatcggcaatcaccagcgtcggcgcgatctgcatcgcataggcgttaagttcggtacgttgatggctaaacagcgccagaacgggcgctacgccaagcttcaacagggcgaaaaaggtgatatacagttccggtacattccccagttgtaccagagcggtttcgccaggtttgatgccctgacggcgtaaactgcaggccagattatccgcggcctggtttagctggcgatagctgaatgcgcgctcgccttcaatgaccgccgtcttatcgctgtcagcgtggcgggtcagaatatcggtcaacggcacgtcttgccagtagcctttttcacgataacggcgggcaaattcatccggccaacgggtgaaaggtatacgcatcatcgttccttaatgcagtccaaaaacgttcaacatcgtagagagcttgacgccggtttcccgccactcgccgactggcgaagaggcaggaacaatcccggcgccggcgaacaggcgcacctgattaccgtgcaatttcgcacaacgaatcgtcactacccactcgccgtttccttcggcatcgcaccagccgacaatgccgccaaacagttcacgatcgaacggctccagttcagcaatcagctttttcgcgacctgatgggggaaaccgcttaacgcaggggtcggatgcagcagacaggccagcgtaagcgcgttttctccggcgttggccttgccctcaaacggcgtaccgagatgccatagcgtcggcgtggtgatcaactgcggagaggaaggtaattgcagttccgtgctgcgatcgcgcaggatctgcttcatcgcctgcgtcaccagctcatgttcatggcgatctttttgtgaagccagcagtcggtttcccgcctcgcgatccagaacgtcatcgggctgtcggcgtgccgagcctgctaacggcagcgaactaaaccgctcgccctccttgcgtagcagcaattcggggctggcgcccagcagaacgccgccatccgccagtggcacatggaagttgtaactaactggattctgcgcaaccagccgctccagcaatgctccgctatccaccgccacatcagtggtgatatctatcagccgggaaagcaccactttatcgacgtctggcgtggcggtcagcatagccgcgcgtgcgaccatcgcttcaaaagcatcctgctccggaatcgcctttcgcgccgtcaccgtcagcggctgatggtcagtaaaataacgcgccgtgcgctgcttttgctggcgggaaaaggactgccacgccatcgggataaatagcgacgacggctgacgggtatcaaaggggatcgcccccaccaggatagggttggcgatgccctgcgatttggcctcggcaaactgctggcgcaatttctgctggaaagggctatccggcgaatctccggcaaccgcaggctcggtataacgggcgaagcacccggaagtggtaaaactgcgatacggcgacatgaagaaaaagcgatcgggagcaagcgttgccattgtctcctgagcgtcctcggccagtgacatatccatatcatcctccaatgataaaggcttatatacacttcatctttcaagctgcctctttgttggctgcgatcagaaaccccggtcacacagttatctatgcccgcggggattcttcccttgccgtcgcgatgcttcttgaatgattttgtgtataataatgattattatttctatttttagtgcgctaacctaagagtaaaacgtcgctctgtcaactctggtcatgagttaaatggcactaaggcttgcatctcgctgccgctgacatgaaaatgagaagcattaactttattaataacaggacgctattgtgagactctccgccttttatcgttggctgcttttagtggttggtttatcaatttcaggaatatccttagcccaggacgccggttggccccggcaaatccaggacagccgaggcgttcatactctggaccacaaacccgcgcgtatcgtctctaccagcgtgacgttaacaggctcgctgctggcgattgatgcgcccgtcgtcgccagcggagccactacgccgaataaccgttttgccgacgatcaagggtttatgcgccagtggagcgatgtagcaaaggctcgccatgtcgcccggctgtacatcggcgaaccgaatgccgaaacggtcgccgcgcaaatgccggatctcattttgattagcgccaccggcggcgactccgcgctggcgctttacgatcagctctccgccatcgcgccgacactcgtcatcaattatgacgataaaagctggcagagtttgctcacgcagcttggcgagatcaccggtcaggagaaacaggccgccgcgcgaatagcggaatttgaggcgcaactgacgacggttaaacagcgaatcgccctgccgccgcagccggttagcgcgctggtgtatactcctgccgcgcatagcgccaatctgtggacgccagaatcagcacaaggcaagctattgacgcagttaggctttacgctggcgacattgccccaagggctgcaaaccagcaaaagccagggtaagcgccacgatatcattcagcttggcggtgaaaatctggccgccgggttaaacggcgaatctcttttcctgtttgccggcgacaacaacgatgttgcggccctttacgccaatccgctgctggcgcacctgccagcggtgcaaaataagcgcgtctatgccctgggtacggagacgttccgtctggattattacagcgcaacgttgctgcttaatcgactggccgccctgttttagccttatcggagtcttatccgactgaccagacagatttggtcagtcggataaacgcgtcttcatcagccagcatcgctaaccggcggcgtctggcgaaaacggcgtagctcgcccagcactaacagcagcagcaaaccgataatcaccagcccgaatccactcacgctcgcggaagcgaccggcgtcatcattgcgccaagaccgcctaacagcgccgcgccgatagcgtctcccgtgacgttttgcgcggtccacaggccgttcattcgccccagcatattttccggcgtctgggtttgcagcagagtgtattgtaataacgaactgatggcgctaagccagccaaatagcgccagacagataacaccagcgatccagatcggcatgatggcgaacagccccaccgccagaaaagaaccgactgtcgaaaccagcataatgagccccggacgaacgctatgcgccagttgtccgctggtcagcgcgccaatggccgcccccagcggaattgccgcatacagcaaaccgatttgcgccgccgacatctgccagctcatcgccagcgccggatagaggacgcgtaccgcgcttgccatcgtcaccaggccgccaagcagcgcaataccgccgataagcggactggcgagcaaaaaacgaaatgccgccagtaacgcgataaatggattttcccgcggctgcggaggaacaggcagtcgcggcagcgtcagtaacggcaatagcgtaataaacgtcccggcggccgccagcccatagttccaggctacgccgccgctggcaagcaatatgccccccaacatcggcgaaataaccgatcccagacgtaccgtcagcatggtaatcgcgccggcctgcatcagattttctcttccgaccagcgctggcgtcgccgccagtaacgcggtcacgcccagagacgcgaaaaagccgtcccacaggccaaggagatatatcgccagcaatgacggttccggcagcagcgcgttcacgcacagaccaataaagccaataccgcaagtaccgcgcgccagcagaatcacctttttgcgttcgtagcgatcggccagtacgccgcccaccattaagccaataaacatggcgccgccggttaacgttaccgacagccctacctgccaggtagagtgcgtcatcatttggatctgtaccggaaccgccacgccaagcagccccagcgagacaatagagataaaacgggccagaaatactgcgcgaaatgcagggtgcgtcttcaacaggctgagattgagcagccaggattgtcgattcattacaacgccttaatgcgagtttttttaaatatccattcaatggctgcacatgctaatataaccaaataagatagataacgataattactatcattatcagggaagttactatgtcatgctcgttttccgtgacgcgcgcgtttgccgtgcccggattgttgttattactgagtctcgccgcggttttaagcctggtcattggcgcgaaaccgctgcccgccgccgtcgtgctggaggcgttcaccggcgtgtgccaaagcgccgattgcaccatcgtcctggatgcgcgtttgccgcgtacgctggccggattactggcaggcggcgcattgggtctcgccggggcgctcatgcaaacactcactcgtaacccgctcgccgacccggggattctgggcgttaacaacggcgccagcttcgccattgtactgggcgcggcgctgtttggtttctccacgccgctggaacagcttttcatggcatttagcggcgcgcttatcgcatcgctgattgtcgccttcaccggtagtcagggcggcggccaattaagcccggtccgcctgacactggcgggcgtggcgcttggcgcggtactggaaggactaaccagcggcatcgcgttgttaaatccagaggtctatgaccagcttcgcttctggcaggcgggatcgctggacattcgtagcctgcaaacgttgaaagtcgcgctcgcgcccgtggttatcgctgggatcgtggcgctatttctgagccgagcgctgaacagcctgagcctcggcagcgataccgcgacggcgctggggagtaaagtggcgcgcacccaacttattggtttactggcgattaccgtcttgtgcggcagcgcaacggcgctggtcggccctatcgcctttattggtctgatgatgccgcatatggcgcgttggctggtgggcgcagaccaccgttggtcgctgccggtaacactactggcaacccctgctctgctgctttttgccgatattattggtcgtctgttagtgccgggcgaactccgcgtatcggtcgtcagtgcgtttatcggcgcgccggtacttatctttctggtacgccgtaaatcgagcggaggcggcctgtgatgtttctttctcgtcggcttatcgtaagctgcctgcttctggcggctggctgcttcgccattggcttatggagcctgcaaagcggcgccgtgccccttgagaccgggcagattattgccgcgctgctgggcgacgcgccgcgtaatatcacccttgtcgtaaccgaatggcgactaccgcgcgtattaatggcgctactgattggcgctgcgcttggcgtcagtggcgcgatttttcagtcgttgatgcgtaacccgctaggcagccctgatgtgatgggctttaataccggcgcctggagcggcgtactggtcgcaatggtcctgtttggccagcatcttaccgcgatcgcgctggcggcaatggcgggcggtatcgtcacgtcattgattgtctggctgctcgcctggcgtaacgggattgaaactttccggctgattatcatcggtatcggcatccgcgcgatgttagtcgcctttaatacctggcttctgttgcaggcgtcgctggaaacggcgctcaccgccggcttatggaacgccgggtcgctcaacggtctgacatgggcaaaaacctggccttcggcgccgctgattatggtgatgctgacaggcgccgcgctactggtgcgtcgtatgcggctgctggagatgggcgatgacagcgcctgcgcgctgggtgttagcgtggagcggtcacgcctgatgctgatgctggtggcggtgtcgctcaccgctgctgcaacggcactggctggccccatctcgtttattgcccttgtcgcgccgcacatcgcccgtcgtcttagcggcacagcgcgctggggattaacccagtcggcgctgtgcggcgcgttattactactggccgccgatgcgtgcgcgcagcaactgtttatgccttatcagcttccagtgggcgtggtcaccgtcagcctcggcggtatttaccttatcgtcttgttaattcaggagtcccgcaaaaaatgaccgaatccgtagcccgtttgcgcggcgaccagttaacgctgggttatggcagctataccgtcgcaaaaaaccttaatgtttcgattccggacggccattttaccgccatcatcggccctaacggctgcggcaagtcgacgttgctacgtacgctaagccgtctgatgacgcctgttgacggccatgtctggctggatggcgaacaaatacagcgttacgccagtaaagaggtggcgcggcgcatcggattgctggcgcaaaacgccaccacgccgggcgatatcaccgtacaagaactggtcgccagagggcgttatccgcatcagccgttatttacccgctggcgcaaggaagatgccgacgccgtcgccagtgctatgcgtgcaacaggtatcacctcactggcggcgcaaagcgtagacacgctgtccggcggccaacgtcagcgggcgtggatagccatggtgctggcgcaggaaacgtccatcatgctgctggatgagccgacaacgtggctggatattagccatcaaattgatttgttggaattgttaagcgatctcaaccgtgaaaaaggctatacgctagccgccgtcctgcacgacctgaatcaggcctgccgatacgccacacatttgattgcattacgcgaaggtaacattgtcgcacagggcgcgccgaaagagattgttaccgctgagcttatcgaaaaaatctatgggctgcgctgtatgattatcgacgatccggttgccgggacgccgctggtggtaccgctggggcggcgatagtcgcccacacagatgacaaagccggatatcgctatccggcttttcgggtaaatcagactaaccgttcatctatcgccagcgcgttttccattttacgcgagaccatcgcgtgacgcagtaatacgccgccgcaggccatcataccgccaatcaacgccgccaggataataatgatcgctttacccgggccatcttttttcactggcagagacggcgacagttgatatttaaacggggtaaacttcacgtcgctcacattcattgccgccagttgttcaacatagtattgacggttacgcaaatcaccgtcgatctcggccacgtccgttacccctttttcaatttccagtttgcgggaaataccatccgcgccgagggaaatagaaaaatccggatcatcttttaccgcctgaccattactgtaaaccggtctcttaatgccagcggcgttggcgatttccagcgaataatgaagacgttgaatattggcatcaagctgatttttgagacgcacccgatccatcgccagcttttcctgctcgtagcgggttttgatttccagctggttacgaatattttccagcgtctctttcacgacgatatcggagatgtactgaatatagccagccaacactttttgcgcttcttcccgcgtcggcgcggtaaaactcagcgtccacgacgtgaataacgacgtttcatttttcttgccggcattgctgtccaccgctttcattttttcgctcagcacgacaatcgcccggtgaagatcctgctcgtctatttgcgcgccttttaattgatccatgacatacggagaagaacgaagatattcttccagcagcgagggcgagctaaactttttaataaacagattaaatacgctggcccgatcaacgcttacctccatatccaacacgcgcagcgcggtcaacgttctctccagcccctgctactgtaccgactccgccggtgtgacaatcgcctggctggtccatttttgcggcagcagaaaggacagaagcaaccccacgcacgcaaaggcgaaaacggtagcaagaatacgacgtttcgcctgccataacacctctataaggctaaacaaatcgatttcatgactgttggcgggcggcagtgagtaacctgcaaatgactgatttttctcttgttttacattaagagatggcatgccgtatgacctgaaaactttatccaatgaaagaacacattcctgtcagagattctaacagcaagtcagaattatccgaaacaatctttacgcgccagtgcccgaaaagctaaatattcggaattaaacttgcctgtagcatgtatcacttatgttaaaagaattaatagttgcaataaaaaacccataataattagtcattattatgggtttcaggatttaatttgttaaaggcagaaacaacgcccgttatttattaataagttcgctgatgatgggcccgatagtttcaaaagcggagggagaaataatatctacatgcgcgcacggctggcgataaatagccaaagacgctatccacggcgaccagctctgttcaggcgatacgtcttccggcaccgttttatccgccacaaagagcgtggcatgtccatcaaacggtgcgctatgcgccgtcgtcagcaaacggacggcatccgcataattgccttcaatggcggtaaataaggcgtcggaggcatttccctgctgcgcggcgacaaacgctgcgcgttcgcgttcaatttccgccaatacgtccggattgaggccattcgcctcttttccccgccagttttgtgtttccggcggccaggtgtccagtaaccccaaaaacgccaccgtttcaccgcgcgcgcgcaaccgggcggcgatcccttgcgccagcgtcccgcccagcgaatagcctaataaataataagggccatgcggctgccgggcgagcaatgtcgccagatgatgttcacatacctcatcaagggtggttgcgatttgcatagggccaacggggcgcggcgactgaatccccataatcgaccacgacgggctgagatagcgtgataatacgctaaattgccaggcgaaccccgacgccggatggaaacaaaataacgttggaccatcgctttcacgcagcggcaacagcggcccgaaccccagattgcgcgagcgttcgtcatcgtcagtatcgagcagcttactcaactgcgccacgtcagacgccaccatcacctgccccggcgtcacctggcggttaaacgtctggcttagctgcgcggccagtttcatcgccagcagcgagtgtccgcccagcgcaaagaaatcactttcaacgtcgttaatctcacagcccagcaggcgggaaaacgccgcggcgacagcaatctccgttgcggactgcggcgcacgccctttcacgcgcggcgtcagatccggcagcggcagggctttgcgatccagcttgccattagcgctaagcggcaagctggcaagttgcaacagcacaaccggcaccatatgcgcgggaagtttttggcgtaatttatcctgcagcgccggtaaatccagcggtaaaccggagtgcgacaccagatagccgaccagttgccgggcatccccgcccgtcgccgccgcctgattaaagacgcaggcatgtgctaccgcctgttcaacatccggcagcgtttgcatgacgcggtcaatctcacccagttcaatacgttgcccccgaattttgagctgatcgtcgctgcgtcccaggtactccaccacgccggaatccagccagcgcgccacatctccggtacggtacatccgttcacctggcgcaaaaggatcggcgataaaacggctggcggtaagatccggacgccccagatagccctgcgccagttggataccggtaagatagagatcgccagccacgcccggcggcaccggctgcatatgcgcatcgagaatacgtaaaccggtattccagacgggataaccaatcgggatactgttgccgtcaacagccgccagctcatcgccacaggccggataccagctcacatccaccgcggcctccgttggcccgtacagattgtgtagcggcgcgttggttaacgtctcccattcgcggcacagcgccgtcggcagggcctcgccgctacagaaaacgcgctttaaggaagcgcagcttttcccagccgacgctggcgtgagcgaggcaataaaggccgccagcatcgacggcacaaaatgggtggtcgtgacgccgtattgcgcaaagaaccgctgcatcgcgagcggatcgcggtgcgcttccggttcagccatcaccagtttcgccccggcgataaacggccagaaaaactcccatactgagacgtcaaaactgcacggtgttttttgcgctactacatcatccgccgtcaacggatagtgatcctgcatccacagcagccggttgactatcgccgtttgtcccaccatcacccctttcggcctgcccgtcgaaccagaggtgaaaatgatgtaagcggtatgatgcggtagcgacagccccagcggagtggcgtcactgaccggtagcggttggctataacacaaatattccatccccggaatatcgtgaaagcgcgccagctgcgcctgagtcgtaattaacagtttcggctgcgcatcttccagcatcattcgcagccgatcgtcaggataaccggtatccagcggcagccaggcggcgcccgcttcgacaatgccgtgcagcgctaaggtcagaaaaaccgaccgcggcaacgccaccgccacgctatcgccaggctgaacgccgcgttcccgcagcgcgtatgccagcgccacaacctgttcgcgcatttcacggtaggtaaagtgataatgcgcatctgccaacgcggaagcctctggcgttttttgcgcctgctgcgccaccaaatcgctaagcgtggcggcgggaatcgttaccgccgtattattaaggtgtgttaattgcgtttgttcttccgccagcagcatttgcgcatcgccgcagcgcagcgccgggttatcagcaaactgcgtgataagcgccatcaaccgtaaggcatggcgggaaagcgtggcgtcatcgtaacgctgcgcattcgccagcaattcaatatccagaccgccgttttcatccggaaaaagcgccagttcaagatcgttaaccggccccgtcgccagggtatgggtttgcgcctgtatgccaggaaaatccagatgataatcaaatacttttatgttgagcaccgggccaaatagcggcgtttcccctgcggctcgcccgctatcgcgtacaatctgttcggcgtcgtaacgctggtggcggcgcatcttctttaactgcgccgcaagacgcttcgccagcgttggcagatcttccgtcgcatgaaggttaaccgccagcggcaacacgttaaggacaggcccggtcgccgttaacgccgctgagcccatccgccgcataaagataaatccggcggcataatccatacgcccacataatcgtcccagccacaacgtcaccagcgccagggcaagatccgctcgcggtatctcaggcatgtgcgccgccagttggcgaaacgcccccgccggcgcgctcaatttcatacgcagaatatccgcgctcgccgaccgccccggcaacggcgcggcagacattgacgccggcggcggcagctcgcggcgctgctgcgcccagaaggcgccgtcacgctgccaggcctcgctctggcgatagcgctgatattcctcaaccacatccacaaagggggtaaaaggcgactccggcgtaggggcgtcgctctgccaggcgcgataaatcgccgcaatctggcgagttatcgccgggaagctaaagccatccaccagcaaatggtgatagcgctgataccaataccagcgggtatcatcaatgcggattaactggtgaaacgccagcggcttaccgctatctgcgcgcaggttttgccgtaaatccgcctgcattaacgccagcgccgcgagatgcggatcgggctggtcgcgtaaatcggcaatcgggggttcgccgaaggtgtgctcagaatctatccattgccagacctcgccgttctcttcggtaaaacgcatccgtagcgtatccgcctgttgcatccctaccgctaccgcttttgccagcaagggggcatccagctcgccattcagttccacatagtgcgccacgctccaggcggagggtaaatcagagagtttttccgccatccagatccccggctgggcggcgactaacggtaaacgctgcgtcatttcgcctcctgcttatcggcataatgcgccggattcagtgttgtccagcgcgtattaagccactgctggcacgcgtcctgcgattgcggttcgcataccacgccccatcctgcgggaagcgcgcacgccgctggccaaaggctgaattgacgctgcgcattttgcaggatgtaaaactgtccctgcggattatcgaagggattactgaattccatactcaactcctgtcatggacatgtgcccggttaaagcgtgtcgataagcggctgccaaagcagcatcagcccttgcgttagcccgccgcgccagcaaagcgcatcgtgtccgccgtcaacctgacgccagaaaatggactgctgcgaggtattcagttgggcataaagcgcctgatttgcctgaaacacgatcggctcacgcacgccggcttccagtacgatacgcagtccgcgcgcgcacaatgcgccggttttcagccgggtaatgacttccccctccggcggggtgatgcgatggggccaccagaacgatcctgactggcttagtacacagccaaaacgcgtcggccagttcaggccggcatacagcgccgacaggccaccaaagctctgtccggcgaccaccgttcgtccggcatcatcgctaaaaggcgtcacggctctgacttgcggcaacagttcctgctgcaccgccagccagaagtcggcattgcagggcaactcctggttgcggtgttgagtatcaatcgcgtcaatcagcagatagacggcaccgggaagcaggcgttgatgagtcagcgaggcgagcgcgggccagacgggcatattttccgcccagaattgaccgtccagcagaatagccaacggtctttcctccgtcgcctcgtctccggtcgtcaatatccatacgcggcgggagttacccagacgttcgctatgccactgcatcatcaaaggcggtgagtacgacgtttcaggacgatcccatcccggctgacggggcgcatccggcatttccagcgctgaaaccgcatgaccacgtcctccccgccagctttgcgaattaagcgggtcggcaatcgcctgcggtaatagctgtcgccagccttcacgcagcgcgttccgatcgggcgtttcgcccggcgcaaaagcggcaaaaacgtcatctcgctcggtaggaataaaacagtagctgccgcgccagttagcgctaagcgccgtgctccagcgccagacatccgttccggcaatacgcgccatcgtctgaggctgcgcgttttgatgatgatcggttacgccagtgatgtagacccagacacgccgtatcggggagtgtgtttcgtttccctgcgggtcgcgccaccaaaaagtgacccgataatttccgtctttttcccgtatccattccggcccggttttcgtcctccaccaggcctcacttcccgttgccagcgcctctttcattataaccctgtgtttattatgaattttgtatataaaaggtgaaatatattgataatattattgataactatttgcatttgcaatagcgtattgtagcgctatgggacgcgcgaacacaatttcaccacccggccaatgcctttgacgggcgctttggcttatgtggctaaagaaaagcaggatatacaatgaacaagaagattcattccctgaccttactggtcaatttagggatttacggggccgctctgcccgtgatggcggaagaaaaaaccgatagcgctgcgctcaccaatgaagacaccatcgtggtgaccgctgcccagcaaaacctacaggcgccaggcgtatccaccatcaccgccgatgagatccgcaaaaatccgcccgcgcgcgacgtgtcagaaatcatccgcaccatgccgggcgtaaacctgaccggcaactccaccagcggtcagcgcgggaataaccgccaaatcgatattcgcggcatggggccggaaaacacccttatcctgatagacggtaaacccgttaccagccgtaactcggtacgcctgggctggcgcggcgaacgcgatacccgcggcgataccgcgtgggtgccgccagagatgatcgaacgcattgaagtgctgcgtggccctgccgccgcacgttacggtaacggcgcggcgggtggcgtggtcaatatcattaccaaaaaaggcggtagcgagtggcacggttcctggaatacctatttcaacgcgccggaacataaagacgaaggcgcgaccaaacgcactaactttagcctgaacggcccgctgggcggggatttcagcttccgtctgtatggcaacctcgacaaaacgcaggcggatgcgcgtaatattaaccaggggcatcagtctgaacgtaccgggagttacgccgacacgttaccagccggacgcgagggggtcattaacaaagatatcaacggcgtggttcgttgggattttgctccgcttcagtctctggagctggaggccggttacagtcgccagggcaacctctatgccggcgatactcagaacaccaatacgaaccaactggtgaaagataattacggaaaagagacgaaccgcctctatcggcagaactactctctgacctggaacggcggctgggataatggcgtaaccaccagtaactgggtgcaatacgaacatacccgtaactcccggatgccggaaggcctggcaggcggcaccgaagggattttcgatcccaaagcatcgcaaaaatatgccgatgccgatttgaatgacgtcaccctacacagcgaagtgagccttcctttcgatctgctggtcaatcaaaacctgacgctgggtaccgaatgggcccaacagcgtatgaaagaccagctctccaactcgcaaacctttatggggggaaatatcccgggttacagcagtaccaatcgtagcccctattcaaaagcggaaattttctctctgtttgctgaaaacaacatggaactgaccgacagcaccatgctgacgccggggatacgtttcgatcatcacagtattgtgggggataactggagcccgtcgctgaacctgtcgcaaggtctgggggatgactttaccctgaaaatggggatcgcccgcgcttataaagccccgagtctgtaccagactaacccaaactatattttgtacagtaaaggtcagggttgctacgcgactggcgcgggtaccggcatcggctgctatatgatgggtaacgatgatctgaaagccgaaaccagcatcaataaagagatcggtctggaatttaaacgcgatggctggctggccggcgtcacctggttccgcaatgattaccgcaataagattgaagcgggtacggtgccgttgcagcgtatcaataacggcaaaacggatgtctatcagtgggagaacgtgccgaaagcggtcgttgaaggtctggaaggcacgttaaacgtaccggttagcgacaccgtcaactggacgaataacgttacgtatatgctgcagagtaaaaacaaagagaccggcgaacgcctgtcgattattccacagtacacgcttaactctaccctgagctggcaggtacgtcaggacgtttctctgcaatcgaccttcacctggtacggcaaacaagagccgaagaaatatgattatcagggtaaccccgttaccggaacagataagcaagcggtcagcccatacagtattgttggcctgagcgcgacctgggacgtgaccaaaaatgtcagcctgaccggtggcgtggataacctctttgacaaacgtctgtggcgtgaaggtaacgcgcaaaccgtcagggatacgcaaactggcgcttatatggcgggcgctggcgcgtacacctataacgaaccgggacgtacgtggtatatgagcattaatacccatttctgatggcaaccttccctccctcattcggggagggaattagcaaaagacgatgctgacatctcattttccccttccctttgccggacacaggctgcatatcgtcgactttgatgcgagcagctttcacgaacacgacctgctatggctgcctcatcacgatcggctccggtctgccggacgcaagcgtaaagctgaacatctggcaggccgcatcgctgccgttcatgcgctacgcgaggtgggcgtcagggcggtgcccggtattggcgacaagcgacagccgctatggccggacggcctatttggcagcatcagccactgtgcgtcaacggcgctggccgtcatatcccgacagcgtgtcggcgttgatatagaaaaaatcatgagtcagcacacggcgacagagctggcgccgtccattattgatagcgatgagcgccaaattctccaggcgagctcgctcccttttccgcttgccctgacgctggctttctccgccaaagagagcgtttataaagccttttcagaccgcgtcacgctcccgggattcgatagcgcaaaaattacctcgcttaacgccacgcacatctcgttacatctgctgccagcctttgccgccatgatggctgaacgtaccgtccgtacagaatggtttcaacgtggcaatagcgttattactctagtttctgcaataacgcgctttccccacgacaggagcgctcccgcttctatacttagcgcaataccccgataaatgagatcgctatggcgctgaatgattttcacgtttctgaaccttatacgctcggtattgagctggagatgcaggtgatcaatccacctagctacgatttaagtcaggactcttctacgctgatcgacgccgttaagccccaacttactgcgggagaaattaagcacgatatcaccgaaagtatgctggagatggccacgggcgtctgccgcgatattgaccaggtggcggcccaactttctgccatgcagcacgttattttacaggcggcgtcggaacaccatctcggcatttgcggcggcggtacgcacccttttcaaaaatggcagcgtcaggaggtctgtgataatgagcgctatcaacgcacgctggaaaatttcggctacttaattcaacaggcgacggttttcggtcagcatgtccacgtcggctgcgcgaacggcgacgatgcgatttatcttttacacgggctgtcgcattttgtgccgcactttattgcgctctccgccgcgtctccctatatgcaaggatctgacacccgttttgcctgcgcgcgcctgaatattttttccgcttttcccgataacgggcccatgccgtgggtcagtaactggcaagagtttgccggactatttcgtcgtctgtcttacaccacgatgatcgacagcatcaaagatttgcactgggatatccgccccagcccggcctttggcacggttgaggttcgggtgatggatacgccgctcactcttgatcatgccatcaatatggcaggattgattcaggcgaccgcgcactggctgctgaccgagcgtccctttaaaccgcaggaacaagactatctgttatataaattcaaccgttttcaggcttgccgctatggtctggagggcgtgctaaccgatgtctataccggcgaccgccgtcgcctggcagatgatacgctgcgtctgctggacaacgttaccccctctgcgcgtaagctgggcgccgacagcgccattgacgcgctacgtttgcaggtgaaaaaaggcggtaacgaagcgcaatatatgcgggagtttattgccgacggcggatcgctgataggcctggtacaaaaacattgtgaaatctgggcgggacaatagacagcatatttgccttaccaggcgatgtcccggacaatggcgttttaacttacgtttaacaaagccatgaaacacccgcttgaatcattgatgaccgctgccggtattttgctgatggcgttgctctccagcctgctgctgcccgccccttcgctcggccttgcgctggcgcaaaaactggtcgggatctttcatcttatggatctcaaccagctttatactttgttgttttgtttatggtttctgttgctcggcacgctggaatattatgttattcgctttatctggcggcgctggttttcgctggccgattaaacatttcaatgcgtacggccatgcttttctttacgataagcgcctggcggcaggttgaacgtgcgggtaaaaatgcgcgtaaaggtttgctgcgaatcaaaaccatacttgagacaaatatcatacaccttctggtcggtgtcgcgcaggtcgcgcgccgccagttttagcttccgttcacgcacgtagcgcctcagactctcccctttgtactgcataaaaaggcgctgcaggtgccacttggaataccccgcatgacgggcaatatcatcaatacgtaacggctgattcaaattatcatcaatccactcgacaatcgtgtcgataacctgagcggaaatggtcatcgtgctctcccctctatcaaactcgtcagcggctcccgcaccgcacatttacggcaacagcaataagcatagtaataaccacacaaattgtgagacggcttatcgcatggcctgcaatatgcttttctaccacttcatgcggcagcccttgattatgagtgagtaagcactcattatagaaagcaaagatacgccgtcaaggtacttttcaaaggttgacattcaccgttgcgacgcgacaacgggcatgattcaatcatgtttttacagacataagggtaacgtgtagtggctcgtccgaagagtgaagacaaaaaacaagcattactggaagcggcaacccaggcgatagcgcaatccggtatcgccgcctcaacggcggtgattgcgcgtaacgcaggtattgcagaaggaacattatttcgctatttcgcgaccaaagatgagctgattaacacgttgtatttgcatttaaagcagaacctctgccagtcaatgataatggagctggatcgatccattaccgatgccaaaacgatgacccgctttatctggaacagttatatcagttggggtctgaaccatcccgcgcgccatcgggcgatccgtcaactggccgtcagcgaaaagatcaccaaagagacggaacaacgggccgacgatatgttccccgaattgcgcgatttatgtcatcgttccgttttgatggtatttatgtcggatgagtaccgcgccttcggcgacggcctttttctggcgctggctgaaacaacaatggatttcgccgcgcgcgatcccgctcgcgctggcgaatatattgcgctgggattcgaagccatgtggcgcgcgctgactcgcgaggagcaataatggacggtcaaacactgcacgcctgtgcaaaacgctttgcgctggaactgccttttaccgaacactgctggcctttcggcccacagtacgatgtgtttaaagtcggcggcaaaatattcatgctgttcactgaacatcactgtcgcccagtggtgaacctgaagtcggccccccaaaaatccctggtgaatcaacaaatttaccccagcattgcgcctggctatcacatgaataagaaacactggatttcagtctatgcgggcgaggatatcaccgtctcgctactcaacgatttgataaatgactcatggaatctggtcgtagacgggctgcctaaaagagagcaactgcgcctgcgaccgcgctgatgcaataaccgtttccgcattttcctcccttatctttttaccgataacccggtaccctgctgatacaaaagggtactaaaccaaccaggagcatttatggatatcgtttctgtcgccttaaagcgctactccactaaggcgttcgatcccagcaaaaaactgaccgccgaagaagcggataaagtaaaaacactactacagtacagcccctccagcaccaattcccagccgtggcactttattgtcgccagtacggaagaaggcaaagcgcgtgtcgcaaaatccgctgccggaaactacacgttcaacgaacgcaaaatgctggacgcctcccatgtggtggtcttctgcgccaaaaccgcaatggatgacgcatggctgcaacgggtggtcgatcaggaagatgctgatggccgtttcgctacgccggaagctaaagcggcaaatgataaaggtcgccgctttttcgctgatatgcaccgcgtctcgctgaaagatgaccaccagtggatggcgaagcaggtttatctgaacgtcggcaactttctgctgggcgtcgccgcgatgggtctcgacgccgtccccattgaaggtttcgacgccgaggtgctcgacgctgaatttggtctgaaagaaaaaggctataccagtctggtcgtggtgccagtcggccatcatagcatcgaggatttcaacgccgggctgccaaaatcacgtctgccgcttgaaaccacactgacggaagtctaatcccctgcctaagccggacgcccgtccggcttttttcacctttctgccaggttccccaatgatcaatggcgcgaagtgccaggttttacatcgttagtgttaacttcctctttcaacctattgaaaataaatgatatttaaaactggcacgccgtttgccatatctggataccccctatctggatgaaggagaaaacgggtgagacatgtttatgtagccagccatggcccttttgcccgcggacttattaacagtctatcgctgctgattggcgacgaacacggcgtgacaccggtttgcgcctacgatggcgatattgtgtcaccacggggttggccctccctggcgtgtcatcaaaatcgggcgctaaacccaacgttataacgggtttgattgccatcgcttaaccctgccgtttgcgccagcccggcgaaagcggacactgttgccgacagcggaaaatctgcgccaatcgcgatatcaacccagtttttatcctgcgctttcccggcacggctaaacgtcagcgcggtcgatttaaggccgccgttcgccacatacgtatcatcgccaaactgacggcgataattaatctgcgcccaggaatgaatgatactgtggcgaagatccagacgccaacccacgctgcccatctgcgaatgggcgttttggtcgccaaaacgcattgatgtactggtattgagcttctcgctataaccattaacgtggctgtaatcccatgcatattgcagcatcggcccggtcgttaaccacggcatcatgacaaaatcataaccgctggttaacctcgcgccccacagccgaccgttggtttcgccctcttccacccgtcttagcgcaccgagcgtgatactgcgctgaatgttactgaatttagcggacaggtagtgtaaatcgccatccagccacgcctgaccggcgcgtaaatggctgaatacggcggcctgaaaaccgcgggcgtcataacgataattatcgtcaggatgttgcttatccagagaaccggctatcagccctcccagcagtacctgctcgttaagctgataatcgacgccaaccgtcagattattatgattaccgttcccgtcggcctcattattatcataacgttgatatcccccgctgtatccgccgaacatgcccagtgaaccaacaggattttccccctggcgaagctgctgataacggctgtcaagcgtggtacgactgccttgcgccatcgactgaacgctttggttcagatatgtcgcctgtaccggcgcggcaatgatcgactgaatatattgcgcaataatggtatggacctgcggaccgggatgtaaatgatcggcaaacagatagtcctgcgacgcattaaatccaggcattgccgaggagcacaccgaagcggatacgcccggcgggcaggccatgcctacggtatttgtcagaccaaacgcctgcgggttggcaagaatttccttaaagaggccgttgatatcggcacgggctatattgccgccgtgttgctccagccccttctcttccatctgattataataatcggtcagagctgacgcctgctctgccaccttttcatagcccgccagcagttgctcaacgagcagttgctgaataaacggattgctgcttaccgttgcagccgccgccagcaacgccttgcggatcgcctgttgccgactggcgaaatcgggcgtagctccctccgccagcgcctctaacgccgcttttagcgccgggggcgccgctgcgcccagcccggcggtgattaccgcctccagaagctctggcgtcgcactaatatccggtacgtttggcaccacgaccagcccggcgccggcatccagtaacagccctacctgcgccgccgcgctagtggcgctattaccggctatttgctgtgccatggcaggtcgcgcgatggccgccgccagatcgtttccgccgacccagtgaatatacaaaccgttgtggtcggcttttccccccgtattggcaagccactgccgtacctgatccgcggtattatcctgcgggtttaattccggggccgtcatcgcgccgccagcggcataattagaaccgccattgctggaagggcttaatgccagcccatatcgttcggccaactgttcgtcgtagagcttattttgaccactatcccaggtccagcgaccgttatttccggtatcgctaaggctatcgccaatcaccgtaagagagtcaaacgcacaggcagataatggcgcggccagcgccagcgagagtatgccgtattttagcagggtacgcttttgggtcatccgatgttccttaatgttattgttgataggtacgacggttctaatcattatccgacagagatattgcaatcgttttaaacattctggttaaaaagttttcattcattgttgacggactggcgcctgttcaaaaagagggaaccgcgtaaaataacgacgtttatagggcgctggataaaatatagcgtatggataaccccagaggcgcttttacccgtctgttgctgattatgcctgaagcgcaggcgtcctgatttgcataaatgccattcagcagtcatcataggctgctgtttataaaggagagattatgcaggaattgatatcccaggtagaagatttagcgggaattgaaatgaatcacaccacgtcgctggtggtgatatttggtattatttttctgacagcagttgtcgtgcatattattttgcactggatagtactgcgcgcttttgaaaaacgtgccagcgccagttcccgcctgtggctgcaaattattacccagaataaattattccatcgtctggcttttacgctacaaggcatcattgtcaatattcaagccgcgctctggctacaaaaaggcagtgaggctgcggatatcctgacgacctgcgcgcagttatggattatgacctacgccctgctgtcgttattttcgctgctggacgtgattttcaatctatcgcaaaaatggcccgccgcctctcagttaccgctaaaaggaatatttcagggcattaagctcatcggcgcaattatcgtcggcattctgatgatctcactgctgattggccagtcaccagcaattttaatcagcgggctgggcgcgatggccgcggtattaatgctggtctttaaagacccgattcttggcctggttgctggtatacagctttccgccaacgatatgctcaaactgggcgactggctggagatgccaaaatatggcgcagatggcgcggtcattgatattggcttaaccacggtaaaagtacgcaactgggataataccatcaccaccattcccacctggtcgctggtttccgactcgttcaaaaactggagcggcatgtctgcgtccggcggacgccggattaaacgcagcattaatattgacgcgaccagtatccattttctggatgatgatgaaaaacagcggctgttaaccgcgcaactgttaaagccgtaccttaccagccgtcatcaggaaatcgatgaatggaataaacaactggatgcgccggaatcagccttaaatcaccgccgaatgaccaatatcgggacatttcgcgcctatctgaacgaatatttacgccaccatccgcgcatccgtaaagacatgacgctgatggtacgccaactggcgcctgacgatcatggtttgccgatagagatctacgcctttaccaataccgtcgtgtggctggaatatgagagcattcaggccgatattttcgaccatatttttgccgtggtggaagagttcggcttgcgtattcatcagacgccgaccggcagcgatattcgcgcgctgtcagggacattgcgccattaatggattgcccgatcgcatgagcatgggatcgggcaaaaaagttaatgagccttacggcgcaaaacggtaaacgcgataaacagaaatacaatccataccggcagcaaaatcgccgacaatcgcatatcgtccatcgtacacattaacaccagaatcagcgccagaaacgcaatgcacaaatagtttccggcgggatagaacagcgccttaaattgcgtctcgcgccctttacgacgcatcgccgcgcgaaaacgtaaatgcgcgagacagatcattatccagtttagcaatagcgtcgcgacaaccagcgccatcaacaggctaaacgctttttgcggcaacagatagttgatcagcaccaccagcgaggtaatcgctccggacagcatcagcgagttcaccggcacgccgcgatggctgacgcgagttaaaaatttcggcgcgttgccttgtacggacaggccgaacagcattcggctattcgaataaacgccgctgttatacaccgaaagcgacgcgaccaggataacgaaattcagcgccgaagccaccacattactgtccaggttatggaagatcatcacaaaagggctgctattggatttcacctctacccatggatagagcgccagcaacaccaccagcgaaccgatgtagaacagcaaaatacggtataccacctgattcaccgctttcgggatgcttttttgcggatcgcgcgcttccgccgcagtaatgccgatcagctccagtccgccaaaagaaaacataatcaccgccagcgacagaagcaaaccatgccaaccggtagcgaagaaaccgttataacgccagaggttatcaatgctggcatgttcgccgccgtggccggagaacagcagccacagaccaaaacctatcatgccgataatcgccagcactttaatgagcgcgaaccagaattccgtttcgccatacagacgaacgttcaccagattcacggcattaatgataataaaaaacaccgccgcccatacccatgttggtacgtcaggcagccagtactgcatatagatgcccgccgcggtcagctccgccatcccgaccagcacaaacatgacccaatagttccagcccgacaaaaagcccgcaaacggcccccaatatttccaggcgaagtgggcaaacgatccggaaaccggctcttccacgaccatttcacccaactggcgcataatgagaaaagcgataatcccggcaacgccatagcccaacaaaacagccggccccgccatttgaatcgccgggccgatgcccagaaacagtccggtgccaatggcgccgcccagggcgattagctgaatatggcggttttgcaacccccgttgaagcgtcggttcattcttcgacgcggcatccgacacgctggcgccggatgcagttgacgcgtttttcacgtcctacccctgtatcgtttttattgaggggcaccttttaacatttcgctctcgctgccgcaaggcgcaatcgtttgtcaaggctcaactccggacgttaacgttatcgtgtaaaaaaagatgtcgcggggagtaaaaagaaaagagtacgcgccgatatagaacgttacgggtgacagacgccgggtataaaatatgtgaataactctggacgaaaagtacgacaccctacagaatacatttagtattttttcagtattttcaaaaaggtgaatcagacctggtatctgttatccatttttgagccacgccaggcgtcaacgtcatgaataagatcatcaaacgtttagagatcattaaaagcgccatcgaacttgaggacgaagagattatccgtcagcagctcatctacctgaaaaatgagccgcaggatgccgtaatcagcgcgattgcccaggcgattgaaactcgtcgattcagtgacgccatgcaagagatcgccgcctggctacaggctcaacgggcgctctcgacgtggcaagatccctctattgccgccagtaaactggagctgaaagcgcttgaagcccaacttcgcgatctgattgacaaacgaaatgcgcgggtacaaatcctcgacgatttcaacgacctctatcatctgcgtctcgggccgttgatgagccgtattctggagttgcgtaaacagctcgcggtgagtatgcagcgtaagcaagaggccgaaataaaacgccgggaaaaggattatcaatcctgcctgcaatttatttcccaggccgtggatcaactggcaacgctaaaacagcagtggacaggattgaatgccgcctcgcgcgaagcggtgggcatccgtcagcgaatccagcagcagacggaattaatcaccgcgttgctggcggaaattcgcgagctggaagcggatttttcccatcaggacgacagcgcattccgccaggcgcaggaaaatgcggaacagaactatcaccagtaccgggagcagcagcaggaagcgtaattccgctacgcccgcgatcaacgtttgtcggcagacgaacgcagtgaattaaaacgtttgtggcgtcaggccagccgcctgtgtcacccggatgtggtcgccgatgaattgaaagaaaaagcgcaccagatgatggtacagcttaatcaggcgcggcagaatgccgatctggcggcaattcgcgcgttattgacgcagctgcaaagcggtctggaaccgatgatggcaagcgacaggctaaataacctggaacatctgcgccataaaatacgccagctccgcacgcaaatcgacgcgctgttgaaagagataacgcagctggaaacggaaaatgcctggcggctcgcctcttccgttgcgaataaggaagcctatttctccgagcaggaacgggcgctaaccgaaattcgcaatacgctggaggcgcaggttcaacaggtggaacaggaacttctggcagggtagtccatcattcatcaacacattgtcggatggcgcaagcgccacccgacgaatcgcggcataaagagagtaagagggtcgctactggcgctgtaaaagtaacgaacgggcggagtccgccatgatcatcaccgcacctgccagcattaacgtatcttttaataccagccgcccggcgcccgataaatacgggaaaccataatgcgcatcgcccagcggcataacccaggcctccggcgtggtgattaaaaacgacagcgtgacaaatggcgtcaggaatgccagcacgccgcccgccagccctaaccagcggctaacagggttagccagtaccagcgccgcgataatcaattccaccacgcccagaccatccgaaaacgcatacgtattattggccgtttgccaggcgcgttcctccggttttagttcgccctcatgagtcagatgctgacgatattcttcaggatgttcatagaaaaaagacataaacgggctgttcgccacaaacggggtaatactgtctgcctcatagggcacaaattttagtagtccaatccagataaaaacgatggcgatactcaggcgaattaatgttaatcccagccgatccccctgacttaacagacgaagatatttatccatctcaggctctccttatttatataatatcgcagtggcgtaacccgtattatcaatacgcattgacgtaattttccatgacgacgcctgtttactttgcgccagtctggcaatagcgtcttcaagcattgacggtgttgctgacaccgcagaaacgctgatatattcaacgtcagttagcggctgggcggaggcggaaaacgccagcggcgcagccaataatgaagcaataagtgtggtaacttttaacatcgagatttccagtcgtgggttatttcaatggtgttataatacgttatgcctgactaaagccttttctttcagacgccagcatatttgtcctgtcgtatttttatggtctgacaggcaaaaaaaagccctgattaacagggctacattatttatgttttacttaatgagagagaagagatcgtttaaagactcactcattgtaggatgggtaaatatctggtcgcgtaacaccgtataaggtaaatctgcatccataacggttttaacgatattaatcatttcatgagaatcgacgcataacaatgacacccctacaatacgctgcgtattcacgtccactaccgcttttagtacgccacgggtatcattcataacacgggcgcgagggatcgccgccaccggtaatgtcaccacctgcaccgttgcgccgcttgcccgcgcttgttcttccgtcagcccgacacgagagagcggcggcgtcataaagacggaatacggtacgttctggcgatcgcgggtactgcgtttgccatctcccaataacccgtcgcgtacaatacgaaaatcatccagtgaaatataggtaaactgcaacccaccggtaacatcgcccatcgcccagatattgtccgccgtggtacgcaggtaatcatccacgatgatcccgccgcgttcgttcaccgccacaccggcgttctgcaactgtaagccagccgtcgccggttttcgccccgacgccaccagcagggcatccacaagatgcgcgccttccggcgtttcaacttgtaccgcgccctccgttgaggatacggcctgtacgttggcgtttaaaattagctcgacgcccttttcctgtaaaatgtgggtaattgcctgcgcgatatcccgatcttcacgaggcaagaattgcggcgctgcttcaaagatagtgaccttcgtaccgaagttagcgaacattgaggcaaattcaaggccaatataaccgccgcctaaaatccccagccgcgccggacgctggctcaggcttagtagcccggtgctatcgaacacccctgccgtcgttgttaagcccgtaatagccgggatcaccgactctgcgccagtattaatgaagatcttttctccccgtaacacccgctcgccgtccgcctgaaatacccgtaaggtatggttatcaataaactccgcccttccctcaatcacatcgacattgtccaggtcggcaagattatgaaaatttttgtcgcgtaaaaaatttacgaccgccgctttgcgttgcatggcgacagaaaaatcgccctcacgttccgcgtcatacaccagcgttttcgttggaatacagccaatgttgatacaggttccgccaaacatactggcggactgttcgataatcgccacgcgccatcccgtcttcgccagagttgccgccaacgtttttcctgccttgccaaaaccaataatgagcgcctgatactgtgtcatcttctttctccgccaaatcaccatctgtttgtcaggacaagtataaataacgtcaaaaaagacagggttatccgtaacgcgtcattttttgtcttatcgtctaaattagcggttaggaaaaacaaggatagaaatgacattgagtccgaaatatagtgatcagagacagaaatggttatccttatttttgaaaataaatctgttctggagtctatatggatgcgcttagtcggctattgacgcttaacgcccctcagggctcaatcgacaagaattgcccgttaggcggcgactggcagttgccgcacgccgctggcgagctatcggtgattcgctggcataccgttacgcagggcgaagcgcaactggaaatgcctaccggcgacgccatgacgcttacgccgggaaaggtggtgattctgccgcaaaactccgcccaccgtttgcgccagtctggcgaagcaccgacacatatcgtgtgcggtagtctacgtctgcacacgacgtcacgttatttccttaccgcgttgccggaagtgttatgtcttgccccgccgccgcatagccccgccagtatctggcttaacgccgccatttcgctgttacagcaggagtcagaacgccatttacctggcgctgatgtcttatacagtcagcagtgcgccacgttgtttaccctcgccattcgcgactggctatcgcaggctggcacggcgaaaagcgtgctcaatttattgctgcatccccggctgggccgcgtgatcctgcacatgctggaaacaccggcgcatccctggacggtcgaaacgctggtgcaacgggtacacatgtcgcgggcgagcttcgcccagctatttcgcgacgtgtccgctacaacgcccttagccgtgttaacaacgctgcgcctgcaaatcgccgcccagaccctgtcgcgtgaagcgctgccggtgatggtgattgccgagtcggtaggttatgcgagcgaatcttcttttcacaaagcgtttgtccgtgaattcggttgtacaccaggcgagtaccgcaaacgggtcaacgcgcttggacgataaacgtatactgaacccgcctacagtttgacgccgcaggcgggcgacacacattatgccgcaaggcgacgatgcctgcgcagccacatcagcttgtaggctgccggaatgatgaacagcgacagcagcggcgcggtaatcatgccgccaatcatcggcgtggcaatacggctcatcacctcagaacccgcgccttttcgatcgtttttatcgcgttgctccctcccgccagcgtaaaggggaaggccgcggtataggcctggcaattgtaaaatccatcgtcattgcgcatcagggaaaagtttctgtcacctccgatacgcgctactcgttttattttgacattacccaaacacctccgttgaactgtagcgatagtgaaaggcgctatcactagccagcaaaataatctgatataatcgtcattatcccgtcacgcgccaaacccaacaactgttttattatttctcttattaacccacaccggagaaataagataaataagtttacatcccttttagctgtcgtttttatttcagctggcgtacacaccgcagagaaaatggaatcccgccaattatccgctacagcacatgagatgatgaataacggtgacgccttcgcgcatcagcaaatggctcagacacagaaacccagcgccccgactactgtggaaaatgcgacacccttttctgaaatggacgactatgaaaaagcaatggtcatccatcaatcgatgaataatgcccattctttctcccacgagatccaggctgaagagcaccataaacagattaaacgcaattagttatttgcatattagcgtcacgtactgcggatggcacaacgtcgcccccgcagaagcttacggattaacataattttgagaggttaaatggcgcgccctgcaggattcgaacctgcgacccacggcttagatgttcctggaactacctgagctaacaacaagttatcccattaccacggcgctcactcgccccatcttcgaaaaacatgcaaagctttgtgtgtcccgtttttgtcccaacccactcagcaatcagcagctccaattgatcggtaacaacgatcaattaataagacaacaataagttcaagctatcaaatataacattattgatcgtttatatcgaaaaaagcaatttgtagtactatactccagacctttccgaatccgctgattttcataatgttgaagttattcgctaagtacacatcgatcggtgttcttaacacgcttattcattggggcgtatttgctttttgtgtgtatgggatgcatacgcatcaggcgctggcgaacttttccggttttgttatcgccgtatcgttcagcttctatgccaatgcgcgcttcacctttaacgccagcaccaccacgcttcgctacatgatgtacgtgggatttatgggaacactgagcgccgttgttggctggatggctgacaaatgttccctgccgccactccttactcttgtcaccttttcagctatcagcctgatatgcggattcatttattcaaagttcattgtctttagggatgcgaaatgaaaatctcattagtcgttccggtcttcaatgaagaagccacgatacctattttctataaaacggttcgcgagtttgaagagttaaaaccgtatgaagttgagattgttttcatcaacgacggaagcaaagatgcgactgaatcaataattaacaaaatagctgcatctgatccgctcgttattccgctttcgtttacgcgaaacttcggtaaagaacctgctcttttcgcgggtctcgaccatgcaaccggggatgcggtcattcctattgatgtcgatttacaggatccgatagaagttatcccccatctcattgagaagtggcaggctggcgcggatatggtgctggctaagcgctcagaccgctcaactgacgggcgcatgaagcgtaagacagctgaatggttttataagctgcataataaaatcagcaatccgaaaattgaagagaacgtcggtgatttccggttaatgagccgtgatgttgtcgaaaatattaaacagatgccagaacgtaatctgtttatgaaaggcgttctgtcatgggtgggcggcaagactgatgtagttggatacgcccgcgctgagcgtgttgccggcgattcaaaattcaatggctggaaattatggaatctggcgctggaaggaataacttctttctcaacatttccgctccgcatatggacgtacattggattgtttattgcaggtatgtcgttcctttacggtacatggatgattatagataaattaatatttggaaataatgttcctggctacccgtctcttcttgtttctgtacttttcctgggtggcgttcaattgataggaataggtattcttggggaatatattggcaggatttacatagaaactaaaaaaaggcctaaatacataattaagaatgggaagaaaaatggttaacaatagattaaaaatggtaattgctatccttatagttttctcattggtgtattcaataggatttattacaccaatgaactctgatgactatacttatgccctaagagagctttcgctttctagcgtaaaaatgcactatttgggatggagcggaagggttgtgtcagatacgctcagcacatctctattaaagtttttctccccgcatatttacaatgcaataaactcagcagcgctaacattaatggtgttgtgctggacaatgatcccagcgacattaacaaagtcgtcaccgtccccatatgtgatgattttcttatttttcttatacttcattgcaaatccagctctcggtcaaactaacttctggcttgttgggctagcaaattacttatggaccaacatgttcattgccatttatatactaatttctatatatttaagcaatgccaaaaaatccaatttaatactctttgtatatgccatatcatcgatatttgcaggttgctcaaatgaaaatacatctcttgtagttgtattaatttctgtagcatatttttttataatgaatagaaataaatatctactgattggcgtattcggatctgcaataggcgcaggggttctcctgctggctccgggaaacctatcccgtgcgtctacaatacaagactggtacaaccaaccacttgcatggagggttcttgagcacttttcagaaaggctgccatcagcaatgggggcatattggcaggtctatattgcatttataatactactaatctctgtagtgttatcaaggaatagtagcagcaaacttatgtttggaagctttttattcatactgggtgcaattgctgcaaatgttgcgttccttgcatctcctgcaatgcccagcagggctctcaatggagcactctgctttatgattctttcgatttcctttgttgctcattctgcatttacgaaatttaacaaagcttccatttatttatctattactacatatgcaatggcttttttatatttcattccatcatacattctctattactcatcaattaaatcaataagcaaacaaacggagattagggaagaaataatagacagggcgaaagataacaaacaagatcaagcgataattcctgattattactttccaccggtactgcatgcaggcccaagtcttgatacgtttaacagtgaagcaatgtctagatactacgggattgatgtaaaaataactgctccaggatttttcgactattcgcgagcctttaatctcaaacctcttaatattaacgcaaaaatatgtaacaacgtttatataaaatcattatggatatataaacagcaaatgggcattaaaacctttgtaatatttgagtttaataagaatcctgctgattctcttgatgagaatacagcgatgttcattagcttaaaaacaaaggatggaaaagttataaatgcagatgtcgacaagaagacatttcaaatagacggaagatggctttcaggacgggcgattaacggcatagattcaaatgaattagaatcaattacatctgggacatgggacgttagaacaggggcgaggacaaatgagaatattacggaaataattaaataacattcatgtataattaatgttccccgccaccaatgggtaacgggcggcggggattcctacatatcgtatgtcacaaatgccccatcaggtttcttagcaagaagtcgcaatgcgccatcagtcccaaaaaagaacccaacggagccatagtgcattaatccagactccggcaactgaccaatacacgcaggatacgcatgtgcccaaagcccatccggttcaactccaccacagatgcaggaacaccgtcttttagtgcggataaactgacccctactggtttcactaccgggtaaaggaatctgataatctgcggtcaatgtgaatcaccacaggtttaacagacacctcagatccatttaagatgacttaaagagaggtgcctatgagcggtaaacgttatcccgaagagtttaaaattgaagcggtaagacaggttgttgagcgcggccattctgtttccagcgtcgcaacacatctcgatattactacccacagtctttacgccaggataaagaagtacgggtcgaactcctccaccaataaagaaataaagagcagtcagatgatcagaccggaatccgccgactcccgaaagagttgaagcgggttactgacgaacgggacatattaaaaaaagccgcagtagactcaattggtcactgcaaccatgaatgacaaaagatggagtcctgaatgcgctcctgatggccgtgtggcgacataatcacccgctatgaatggcagtcgatcctgaaatcgcacggactggagggcagtatgagccgtcgtggcaactgtcatgaaaatgcggttgcagaaagctttttccagctactgaagcgtgaacggataaagaaaaagatctacggaacgagagacgaagccagaagcgatatttttaattacatagaaatgttttataacagtagacgtcggcatggttcgagcgagcagatgccaccggctgaatatgaaaacctatatcatcaacgactcagaagtgtccaggttatccgtggcgattcacagatatgctcaccttgcgcctaatcatttaacggaacacgcgaggaaaatagacgacatttttggtgatgatgtcccaaatatgtcccatatggaaaataaggaggaaataaagaagcgtaacgcgttgatttataagtggcgcgccctgcaggattcgaacctgcgacccacggcttagaaggccgttgctctatccaactgagctaagggcgccttgtgaagtgaagacttcatgtagacgaaacgcgagaattatacggtcaggcactcctgagtcaatggcttttgttctggttgctgactaagtgtacgaatatcgtcttttctggcgcaatgccaggttccaggaaatcgcctggacacatctcagcacgcataaagtgggaattaaagccgccagtatttagataatcaatcagtttctttaatatttcaccatgactcacctgccgtgtaggatattttttatgctgagtatcgctattaaggaacaaaacagtcactttgagcatggtttgaaaatcatcatgacgcgtctggcgaatcaatggcagcagaaaattgactttctgccgccagaagagatagataatgccgatatcgctttcctgaccctggatgatgattggttcagcgcaggctgttaccagatacctatgcatactcaacatcagctacgggtaattatttgtaataaatgcgataaagaaaagctcatgttcagaccatgtctgtatatgctgccgcatatttatcgggaagatgatgttgaagaaattacccggaaaatgatattgatcttacataagcgagcgcttcgacatagcgtcccttctggcatctgccactactgcacgactcgccatttttcagtaacagaacgtcacttattaaaactgatcgccagcggttatcatttaagcgaaacggccgctttactttcactttctgaagagcagacaaagtcactccgccggagcattatgcgaaaattacatgttaaaacggagcagcagtttttaaaatatattagagttaaccttcatttcttactcagtaagtaaactcacttaactttttacaaagcttacgaaatatctcaccaataattaagtaacgatacctacaggcatttttttaacgctgccacaatgatacccataatatcctgatagattcaggggtcaaaaatatatggctgcatcataaatgcctgaaggagtgtttggtggcacagggtactttattaaaggaaaggataaatcccccacacctggcgtcttcgccaacacgccattcatatctcaacagcggattgttaaaatctgagccaatcgttcatctctcaactgcgcaattaatcggctatgaggtcctgacgcaacttccgtcagaacatgatagcgaagttttttttcagcagttaatgctgatggaaggcattgaaacatcagagcaacgaggcattgctttttacgctggtgcaacgatgggacaaggttatttatggccagccatattaccagatatatattagagcaatggaaaaagcaggatgcgcagcgtaccatgcagggaaagacaccgccgtttaagaaatgccaaagactgcgcctgccgttatcactctccaacgccgcagatatttgatcgccttgagttactgaaccaacagctaaattatgccttgccggttggtatcatttctcaggcaataattacaactgataactacctcggctattcattgagtcactacttattttccggaaaacgtaccgcagcattccgctcattagatgacatttctttgtggattgaaaaggggtcgctcagacaactgattgtagatatggagacgctacctgtctcctgtattgaggcgcttaaccagctacacgcgctcagttggcaacaaagcgatatccagatttacctgctggtatcagataaaacccccgctatagctcagtttatccgtatggctgggcgtttttttgtcctgtcgcgacgacaaaatctggcctctgtacgcgaagccttgttatcagccgccgaacctcgcttatcggaaagctttagccgtactgactggttgatgattgaaactttagcgcaaggtgcctctttaaaagaaatagcacgtcagcaaagcgtaccttatcatcgtgtggtttaccggcttaaacaacttatcaccctccttaaccttccccacaggcaaagctttcttcggctgatccagcagctaaacgttactttccacgacattttttaacgaagtaacgttttggtgaataagattttttaagaaattacttattttcactgccattaaatgtaaatatttcacataaaattaatatttacaactcgtcctggtaagcgacaaaaaattttttcttacatcgtcccctgttcctccttgttttttgcggtctccagcgtcaacatctttctgttattacataacaaatactaaacaattagtctttcatattatttttatacttaaaaacaacagtttaaactacttaatgtcaactctaaagaaaatagctccaccacgaacaaattttctataacgtcacagaacatcctacccgctatccataattcgcatttcgcaagacttttccgagaaatcagaccaggtataatccatattgtttttacttaatcagaaatttcttttttgttggtgcgaaatggatattccacatatttattactcttacgcaaaatagccagtcaacagggaggtctcattctttattattgctccaccgtgtggtgtgtagatctggctatttcacaatctttaaggtgtctgacgcttattctaaaacgaaggacgcataacagtctgaggcatacaacaatgaaacctgcatctgttatcattatggacgaacaccctattgtaagaatgtcgatcgaagttttactcggtaaaaatagcaatattcaggttgtcctgaaaacggatgatagccgaacagcgatagagtatctgcgcacttatcctgttgatcttgtcattctggatattgaattaccgggcaccgacggctttaccttacttaaacgaatcaaatctatccaggaacatacccggatactttttttatcgtcgaaatcagaggctttttatgccggaagagcaataagagcgggcgcaaacggatttgtaagtaaacgcaaagacctcaatgatatttataatgcggtaaaaataattttatccggctattctttttttccatctgagacgcttaactttatcagtaatacccgtccccccaaaggcgggcaccatgatatgccactttctaaccgcgaagttaccgtgctgcgctatctggccaatggaatgtctaacaaagaaattgccgagcaacttttattgagtaacaagactatcagcgcgcataaggccaatatattttctaaacttggccttcactctatcgttgagcttatcgattacgccaaatcacacgaattattgtaaatgtactcccggcgaattatcgttcgggagccaaaataacggacactaattgtaattgatcaggaaggtcgcatccgcgttagcaagaccgggctgcacgccatcggctaaggcgatatagttcgcatagaatttcagggtagcattgccgttgttgtcaatatcgacggccttgctggcctgttcaagtggcaatcgacgttgatcgccatcgcgaatttcaatcgccagtttttgcgccattgccgtatcagcaagcgccagtaatgccgtgccgggcgctggcgtcccggaaaacgttatagacgccgaacctggcgggcagccttcaagttttaggctaaaggctaccggttgcgtagcgtccccggcgacgtgaagctgttttgtcggccaggtgccgaggttaaccgacttgttactgtcgcccgcaaccacggcgcaggtaaaatccaccacgttaccgcgcagttcaatattcacttcgcccagagatgagttggcctgactcagcgggcttaacaaaacacaaccgatagcgatgaaaacgcgccgaagaatcattatgcctccttaatcataatcgactcgtagatagccgcgcgcagtaaacggcccttccgccggtttattccccgtcacgctgatcggccaggcgcgaatacctacgcgagcggcggcgttatcatcaagatgaaacggaattttactcgacaaattattgggtgtgagcggcgtaccgttgctattagcaaccacaaagcctaaatccgggttatcggacaccatcgcctgccctgaggccttttcggcttcaagccgcatcgataaataggcttgcgccgcgacgttggtacatttgatagcgatagttttcgcttgcggcgtgacgccttgcggacgattacccgctcccgcctgactaaataacggcgcgccgatatcgccgaaatcaaactccacgacctgtccggcattcacttcacagttttgcggtacttccactttgccgctgtagctaatggtatacaccggcgtgctcaacgcgtcgccggtagaggtcgtcacatagacggtaaacattgtctggcgggggatcgtcactatattaataaaaggccgtatcacttttaatttaaaaaccagctttgagtcctgcacgccaaacggcttttgctgcgacacgttagagtcgacgcccatgcgaatatagttacggggcggataaaatacgccagcgacactatcggttatgctcatcgcgcccagaaggtagtcattcaacttgaggtatttaaaatttccttcggtgctttgtaccggtaattctgatacatagcttcggtaggtataattcaccgttgtccccgccgggcacgtcgcgtttacgccgcaccaatctgattttttcagcagcgtcaccacctgtcccggctgattattgccgctggtgaaaacatctgacaggtcataaaagatatcggtcgccgtcccgtttgaattacggcaaaccgtcgccagcgcgggatgggtgaaaaagagtgcggtccccgccagcaatagcgctgagtatattttcatctctatttttccttttatgacgacggacggatacaggtcgcgctggctatcgtaatcgcctgcttcaggctatcctccgccagggcgtaaggggcgatacaacgcgcgtttttcccctctccccactggatgaacagttcaccttttagcggcaagccgctcagataaatttgtccgtcatcgccgaccatgctggtaatgccgctggcggtttctcgtactatcgcgccaaacggtaacggacgtccgccaagcctcgcggtaatgattgcccttacgcctatccgcgtatcaaaagcagcccgcaccagcgcgccttcagtcggcaccacgctgctgacgttattttcgacatcggtatggttgtccatcgtgttggtatctaacgcgacgcggttatagcgatataccgtggcgtagggcattaccgcatagccccgccagtccgttttcacgccggtctggttttcgatgcgcacgcctttcgctcccggcgctttaatcaagacattggtatcgcccaacggttggctaaacgtaataccatccgtatgaccgaccacgccgccggaaagttgccagttatagtcatgctgatcgcgatcgtagttatatcccacgcccagcgtgccatacgtcgcctgccagctagcgctggcgctgccgctatgaccattggtactgctacgcccctgcgtcacgctgtagctcagattacgtccttccagaagcgtgccgcccacaccggtctgccagctattgtcgccgtcgcggttgcggttggcgttaaacgtggcataagtacgatcaagaatagtgtcgcgcgcatagcgccgtccggtcagaacgctaaacggaacggacatattgaatgccagaatgcggtcggcgcctgagatccccaccgactcgctccacgaccatgacagcgaataacttatgccttgccatccactggcgtatcccagttgataccaggtattggtatccgccgtattccagtaattttgttgactgccggaaagatacagtgacccgtaattccccagattttgcgaaatattgacctgaaagcggccttttttgctgtagcggagattgtggtagctctgcgccaccggcactttatggcggcgtccgtcgctatcgtattcgtagtcgtacccttccatactgcggtatgccacatcatccagggtgtaaaatccgcgcgtggaatagcggtaacccagcaattgaaaattagtcccgtaattattcagcgatttggcgtacagaaaacgcaacgattgcccctgatgggtgctgtcatctgccagttggctacgcgcatgtgtgacatcgaccgacacggccccccagtcacccaaattttgccccgccccgaccaccacagcacggtaacgatcggcaagttgcgtaccgccgtaagccgtcagccccgcaggcaggccggcaatcaccgttccctggaaaaagaatagcgaagactgctgactattgccgctgcgaaaatccccggccaccaggtcatacttcaccctgccctcacgctgcaatagcggaacggtagagtaaggcaccgtgtaacgttgttggctaccgtctttttcatctaccgtcacctcaaggtcgccgctggaagaggtaggattaagatcggtaatcgcaaacgcgcccggcggcacatagctttggtagataacatacccgttctgtcgtatcgtcagctttgccgccgtccgggcgatccctctgaccgtgggggcgtagccctgcaggctatcgggatacatattgtcagaagagtacagccgcgctccgcgaaagccgacgctgtcgaaaacatcgttcccggtatggctgtcccccatgaccagttcgctttttagcggaatgatggcgcgctgtacccaggtgccaatgttgttccagcgttgcgaatgatagccgtcccctttcgaatagctccaggctccgttattacgcagccgccaggggccatagttcaacccgctcagcagactcaaaaaatagctatcgctgtctgttccgcggctaccggtaaaactgtaattaatgagtgcggcgggtatcccttcatcccactcttccggcgggatatagccacgcgcgctgttgagcaatgacgcctgcggcaagctaatgtttaagcgcatcgacgcgaaatcgaacgcgacctccgcgcccgggattttctcaggaaggtgaatacacgtggtatcgacgcctttatctgagacagggaacaccgcggtattcacgcccagccgtttaatcctctccggtgtaaaacaaggcatcaggccgccggatttatcgccggcgcccacggcgcccgcctcaaaacgaatatcctgcgtcgctacgaattcgtcgttacgccagatatccacccggtaaataccgggaggctgatgattacctttttcaaagcgagataaatccgccacggacgcggtatccgccgacaaaaacgcagggttgaaataactttcgccgcggctcgtcagcggacacagagctgccaacaccgacagcgccacgccgcttaacggtgatacatagccgggaaatcgccctgcaaaccaggttgtcttcttcatcgtgttctcgtgtggcttcacgctctctgcttaaccgagactggctgttgtcgccgacgtcaatgcgccgtaatcattgacggtctgaaatgtcacgctgccctgcgcgccagtcggtaagggaatttgcatgtcgctttttggcgcgatcatcacgttatcaatctttttcgcacccacgctgatattgaccagcgtgaggtaataagcagatgggttggttatcttgagatggttgccgacacgggaaaatttcagcaaggtcggcgcgtcttccggcgtctgcggcaaattcgccggacgcacgaacagtttgatgcgcgacagaatcgccagttgcagaacgttttttccttcaatatgacttttatcgaccgacgggatggctttcacgttcatccagaataacgactcccgatcctcgggtagcggttgcccggcgtagataatacgcagcgtgttttcacttttgggctcgctgacgaataaaggcggcgtaacgataaacgttttttctttctgcccagcgttattttcgatccatgaattgacgaggtaacgttcttgagtatcgctattactgattgccagagaagtctgtttcgccgccgagggataaataacacgcgtggcgcctaatgcaatcccccccgccgcctgtacgttcagcgaagtaaataacgtgagaagaacaataaatcctaattttatactattcagcatggtaaaaaataccttttgcattgagtcacgtcggcaagaaaattcatgggtaaaccagcgtaaaccacacttctgaatgaattcgtcccggcgtcatattttctgaaattgcccgatagcgggcggtaaaatgcaaagtcatttctgacgttaaaatgggcgcgtaatgaagcggtaacgtgttaggtatgatttgccgctgctggtcatcaaataacgccaggccgattccggcattaccgataccttcgccgctggccagaaaaacatggggatcttccgcaggcgtaacgccggcaaacgcaatgccgacatgacgccagacctccgcgctacaggagattaaccgtaacgaaaatggaacgctgacgggagcgaagctgccaggaccggtaaacgcattcgtgcggtactgtcccatcagtacgcgcaaatcctggctttcagtggcgacagcgcagccgccattgaccagttgtccgcgcaggtgaacacgcccgctctctaccattaccggctgcgcaatgacgggcgacatcaaaacaagccccactagcgccgcgcctttccttatcatctgctatgttctcttttatccccgatagcctcttccgttgagacgcctcccttccctggcgttccctgacgggattattcgtatttcatgataaaggtggcgtcggcattagcctggcctggcgtcgcggcggcggttgccttatagcgtgcggtaaaacgcagcgtattggtgccttcaaccagcgcctgcttcgccgagaaggtcgcgccgtccggcttcaacggtgaggaggtgttatcaagaatctcaatcccgacgccggttgcggtagtgctattgtccgcagaggagaccgccagcaaattagtgttggtgttatctgcctgaccagagaaagccacggcagcggtggccgccacttttggatcgcagtcattcaggacgatggagaaaggcacctgcgcggtcgtatcaccaatcgccgtaaagctggcggtacggtattgacccagcgtcaccgtttgatcggcggatttagtgctaacggcacaggctgcataaaccagtttaccttcgaaatgaatagtaccgccgctcacgctcaccggagtaggatcagccgcaaccgctgcgccagcgacaaacatcagactcgcaatagtagaggtcattaatttatgtttcatggattttccttgaattacacacacccggtttcgatatcctgtcggctccgtttgaattattatcgacatagcatgtcagaaaagttatctctgcatcctgtaaagatagatatcgcagattaattagttttctgtttctcccctgagtatcagacgcagtaattaatctttgcgaatatgacatttcgtcacggtaataaattaaacatttcgctaaataaaaaatagccgcaaactcttttaatgacctaagctaattcttatttggatataagaagggtctaatcttattttgtataaaatgtcgcattatgccgcccgatgctattaacggcgagggattacggtaaccatagccagggtgatgaattgtttctttttggttaatcatggcgcgcttactggtcacgtctcagtatcgtcaacggacgggggagacgtcgcgtttgcatcggaaacacaaacgttaactgacagcgaggcccgcttctgacaaaatagcgttatcccctttgacttgaagtaacagatggaatcttctctctgatggcagcaaagattattgacggtaaaacgattgcgcagcaggtgcgatctgaggttgctcaaaaagttcaggcacgcgtcgcagcgggtcttcgcgctcccggcctggctgtggtgttggtcggcagcaatccggcctcacagatttatgtcgcaagcaaacgtaaagcgtgcgacgaagtgggattcgtctcccactcctatgacctgccagaaaccaccagcgaagccgaactgctggcgcttatcgatactctgaatgcagataacacgatcgatggtattctggtgcagttgcctttaccggcaggtatcgacaacgttaaagtgctggagcgtatcgcgccggataaagacgtagacggttttcatccttataacgtcggtcgtctgtgccagcgtgcgccgcgcctgcgtccctgtacgccccgcggtattgtgaccctgcttgagcgctacaatattgatacctacggcctgaatgcggtggtcattggcgcgtctaatatcgttggacgcccgatgagcatggagctgctgctggctggctgtacgactaccgttacgcaccgctttaccaaagatctgcgtcatcatgtcgagcatgctgatttgctcattgtcgccgttggtaaaccgggctttattcccggcgaatggattaaagaaggcgcaattgtgattgatgtcggtattaaccgtctggaaaatggcaaggtcgttggcgacgtcgtgtttgacgaagccgcggcgcgcgcgtcatacatcacgccagtaccgggcggcgtcggcccgatgacggtcgccacgcttatcgaaaacacgctgcaggcgtgcattgaatatcacgatccacaaggaaaataacatggcgacattctctttaggcaagcacccgcacgtcgagctgtgcgatctgctcaagctggaaggctggagcgaaagcggcgcgcaggcgaaaatcgccattgccgacgggttggtgaaggttgatggcgcggttgaaacgcgtaaacgctgcaaaattgtcgccgggcaaaccgttagcttcgaaggccaaagtgtgaacgtcgtggcctgattacgctgtcttttcagataatcatccacttaatcctctacgttccaactgctagcatggctatttccctgtgaacgatcgctatgcctaccgttatcacccacgccgccgttcctctgtgtcttggcgcaggcttaggcctgaaagttatccctcctcgcctgctgtttgccggtgttgtgctggcgatgctccccgatgctgacgtgctggcctttaaatttggcgtcgcctacggcaacgtgttcggccatcgcggatttacccactctttacttttcgcattcgtcctccccctgttgtgcgtactcgcgggacgacgatggtttcgagcggggcaggtgcgctgctggctgtttttaaccgtttcattgttgtcgcacagcctgctggattcgataaccacgggtggtaaaggcgtcggatggctgtggccgtggtcggatgaacgtttctttgcaccctggcaggtaattaaagtcgcgccgtttgcgctttcaagctacatcacgccgtatgggcatcaggtgattgtttcggagctgctatgggtgtggctaccggggggcgtgctaatagggatattgggctggcacagatggcgtataggggacgaaaagcggactcgctaatgtcggacggcgctacgcttacccgacctgtagatttcatctcaggtaggccggataagacgccctgcgtcttatccggcaatacggcaattacttacgtcgccaggtggtgccctgcgggccatcttccagaataatacccatttcagtgagacgatcgcgcgccgcgtccgccgccgcccagtctttcgctttacgggcatccagacgctgttgaatcaaggcttcaatttccgcaacttcaccgtcatccgcctgcgcgccgctttgcaggaaaacatccggctcctgctccagcagtcccagcacgccggaaatcttccgcagatgagacgccatcgcattcgcggcggtcatatcttcgcccttcagacggttgacttcacgcgccatgtcaaacaggacggagtaggcttccggcgtattgaaatcgtcattcatcgcctccacgaaacgcgcttcaaacgcttcgccgcccgccggggccgctgatttatccgttccacgcaatgcagtgtataaccgctccagcgaggcgcgcgcctgcttgaggttctcttcgctgtagttcagttggctacggtaatgcccggacatcaggaagtagcgcacggtttccgcatcgtagtatttcagcacgtcgcgcacggtaaagaagttgcccagcgatttggacatcttctcgcgatccaccatcaccataccggagtgcatccagtagttgacgtattcgccgtcatgcgcgcaggtagactgggcaatctcgttttcatggtgcgggaacatcagatcggaaccgccgccgtgaatatcaaaatggttgcccaactgcttacagttcatcgccgaacattcaatgtgccagcccggacgcccttcgccccacggcgacggccagctcggctcgccctctttcgacattttccacagcacgaagtccatcgggttacgcttcacgtcaacgacatccacgcgcgcgcccgcctgaagctgctcaagatcctgacgggaaagctgcccataagtcggatcggtcggtacatcaaacatcacatcgccgttatccgccacataggcgtgccctttctcgattaaggtgcgggtgagctcgataatttcctgaatatggtgcgtcgcacgcggctcgctgtccggacgcagaatattcagcgcgtcgaagtcctgatgcatttccgcaatcattctgtcgaccagcgcgacaaaactttcgccgttttcattggcgcgtttaataattttatcgtcgatatcggtaatgttacgcacatacttcagcttataaccgagaaaacgcaaatagcgcgcgacaacgtcaaaagcgacaaacgtgcgtccgtggccaatgtggcagagatcgtaaacggtgataccacacacgtacatgccgacttccccggcatgaatgggtttgaattcctctttttggcgcgtcagtgtattaaaaatttttaacatcgaagattccgtatagacgtgtgtgggtaattaggtgtgtataatactcataattcaaccttgaagcagcacactttgcaaggtgatcgcagcttacgattatgctataacaagcccctatatgtgccccattgcgggctaaagcaccactctcttggaacaggatgcaaaaatggttactttccacactaatcacggcgatatcgtaatcaaaacctttgatgataaagcgcctgaaacagttaaaaacttcctggactactgccgcgaaggtttttacaacaacaccattttccaccgtgtgattaacggttttatgattcagggcggcggctttgagccgggcatgaaacagaaagccaccaaagaggcgatcaaaaacgaagccaacaatggtctgaaaaatacccgtggtacgctggcgatggcgcgtactcaggcaccacattcggctaccgcgcaattcttcatcaacgtggcagacaacgacttcctgaacttctccggcgaaagtctgcagggctggggctactgcgtctttgcggaaatcgtagaaggtatggacgtggtagataaaatcaaaggcgtcgccactggccgtagcggtatgcaccaggacgtaccaaaagaagacgtcatcattgaaaacgtgaccgtcagcgagtaatcgtggcgacactgtttattgcagacttgcatctgcaaacggaagaaccggcgatcgtcgccggttttctgcgttttttagccgtagaagcccgtcaggccgacgcgctgtatattcttggcgatctcttcgaggcttggattggcgacgacgaccccaacccgctacatcgtgaaatggccgttgccattaaatcgctggttgattccggcgtcccttgcttctttattcatggtaatcgcgacttcctgattggcaaacgctttgcccgcgaaagcggcatgacgctactaccgcaggaaaaagtgctcgacctgtatggccgcaatgtgttgattatgcacggcgatacgctctgtaccgatgatgccggatatcaggcgtttcgcgccaaagtccataatccgtgggttcaacggccgttccttaccctgccgctgtttatccgccgccgtatcgccgccagaatgcgcgccggcagtaaagccgccaacagcagcaaatcgctggatattatggacgtcaatgcgcagaccgtcgtcgccgaaatggaaaaacaccgcgtacagtggctgattcacggtcacacccaccgcccggcggtgcatgaactttccgccaacggccagcccgcgttccgcgtggtgttaggcgcatggcatcatgaaggttcaatggtaaaagtcacgccggataacgtggagttaatcgccttccccctgtaaatgttcgtcgaatcgtccgttacggcgcacacgcaaccgttttccttgcctgattatcatgctattctctgacacctcaaaagcagcgtgtcccgcaccacaggagttttaagacgcatgtcttcccgcaataatccggcgcgtgtcgccatcgtgatggggtccaaaagcgactgggctaccatgcaattcgccgccgaaatttttgaaattctggatgtcccgcaccatgtagaagtggtttccgcccatcgcacccccgataaactgttcagcttcgccgaaacggcggaagagaacggatatcaagtgattattgccggcgcgggcggcgcggcacacctgccgggaatgattgcggcaaaaacgctggtcccggtactcggcgtgccggtacaaagcgctgcgctcagcggcgtggatagcctctactccatcgtgcagatgccgcgcggcattccggtgggtacgctggcgatcggtaaagccggggcggcgaacgccgcactgctggcagcgcaaattttggctacgcatgatagcgcgctgcatcggcgcatcgccgactggcgcaaagcacaaaccgatgaggttctggaaaatcccgatccgcgggggacgctatgaagcaagtttgcgttctcggcaacgggcaactgggccgaatgctgcgccaggcgggcgaaccgctgggtatcgccgtctggccggttggtctggatgcagagcctaccgccgtgccggtacagcagagcgtcattaccgcagagattgagcgctggccggaaaccgcgcttacccgcgagctggcgcgccacccggccttcgtcaatcgcgatgtatttccgatcatcgccgaccgtctgacacaaaaacagcttttcgataaactgggactcgcgaccgcgccgtggcagctgctgtccagcgccgacgagtggtccggcatctttgaccgtctgggcgaactggcgattattaagcgtcgcgttggcggctacgacggtcgcgggcagtggcgtctacgcgcggacgaaaccgggcaactgccggatgactgctatggcgaatgtattgttgagcgcggtatccatttttccggcgaagtgtcgttagtcggcgcgcgcgctcatgacggcagtaccgtgttttacccgctaacgcacaatttgcatcaggacggcatcttgcggaccagcgtcgcgttcccacaggcgaacgccgaacagcaggagcaggcggaatcgatgctgtcagcaattatgcaggcgttgaactacgtcggcgtaatggcgatggaatgttttatcacgccggaaggcctgttaatcaatgaactggcgccgcgcgtgcataacagcggacactggacgcaaaatggcgccagcatcagtcagtttgaattgcatttgcgcgcgattaccggcttgccgttgcccgcgccggtgattaacgccccgtcggtgatgatcaatctgatcggcagcgagctgaattacgactggctgaagctgccgctggtacatctgcactggtatgataaagcggtacgtccggggcgaaaagtcggccatctgaatctgaccgacagcgatacgtcacgtcttagcgccaccctggaagcgctctctccgctcctgccgggcgaatacgccagcggcattatctgggcgcaaagtaagcttaaataaacagcgtgggcggcgcattctctgtcgccgcccgtcgcgatcacagacagatgcaggttcccgccctgcccgccagggtatcgtcaatacgcgacagcgcgccaatccatgccggctttccgcaccgcttcacatacccgcttaccgcggtcaccttcggtcccatcgcgccatcggctttggcaaacggcgccagctcatcgggcgaagcctgacgaatagcgcgctgctgcggcgttccccaatgttcatacaccgcatccgcatccgtcaaaatgatcagaccatcggccgctatctgctccgccagcaatgccgccgccaggtctttatctatcaccgcctcgaccccttcgccctcgccagcaacaggtaccccgccaccgccgctgcaaatcaccacatggccctcttttagcaataactcaatagcggtgctttcgataatctgacgcggcgccggggaagcgacgacacggcgcagatattttccatcacgtttcatatgccagccataagtcgcttccagcgccatttgctcttctggcgaataaacgggaccgataaacttttccggttcaagaaaagcaggatcgtccgccgatacctttattcgcgttaataccgcagtcaccggcggcatatcgggttcaagcgccagacgctgcgccagcatatagccgatcattccctgactttccgccaccagcacatccagcggataaggctcaacggctttccaggcaaggttctgtaaagccaacaggccgacctgggggccgttgccatgtactatcgccagccgatacgagcgggcaagtcgtgccagcgcaggcaccgcgtcggcaatattgcgatattgattctctgccgttagcgcttctccgcgctgcaataatgcgttgccgccaagagcaactaccaacgttttcattccctatccttttactatttgttgtccaagccagaaccccagcagcgtatccgcgccagaggtgtgccccagcgccagcagtccgtcaatcgccgtttctgtgcgagcatctcgtcgcagcgcatgaataaagtggagtaaaggcgacgcgaaataccccatagccgcatagcgtaaatagctgacgctcacgagcgtcgtcgcccgatcaaggctgccggattgggcaaaaaaattacgcccggcgcgttcatctatggcgccaaaataccaggccgccagcaacattcccgtcagcgtgtcctcatgactgggcgttaagcccggccctttacccagccatagccgccagtcagtcgcagcacctgcaagcgctgactgaaagcagtgacaaaactggcgaagttccggacatagaggctgagctgcggcgacggttaacggcccaaacagtcccgtctcctcactacgctgcatgtacgtcgcgttaaggcgcggcgacgcaagatagcgtggaacccgcagcgaacagcgcctctccggctcgcataaaagaaactcgccaatctgaataccggcagcggttaactgcggtttttcgccatcggtgagcacatcacgcaaggcgtcaaaatcgccgccgcgcagtatccaccctcctggactgaagccgctcccccgacggtgaagcgttaataactcaccgcttttcgccacaaaattaatagagcgacgccatacccctgacatctgccagggttgccgataatccgccgattgtcggcttgccataagaggatggatacgtttcatgagacgctctcttaacttacgcccatgctttccgccagcgcttccagcgcctgctcgaaacaggccagcggcgcacggacggttcccgcgccaatctgaccaattcccgcctctttatgcgcgatacccgtgttaatcagcggcgtaattccggtctcgaccacgcggcggatatccagtcccagacaggccccctgaaaatcccagccggggatttgtagctgcatgttgcgttcgagataaatttcagccatctcttcagaaacagatttcgccgcttccattcccccggcaccgacaaaacgcgttacgccaggcgcggcaatcatcgctgcgccgccaataccaaacgtttcagtaatggcgctgtcgcccatgtccgggttggcctgatcctgcgaaaaaccggtaaaaaatagcccctgcggcgtattaacaggcgcggtgaaccaacggtcgcccagaccgctaacccgaatgccaaacatatcgccattgcgggtcatcgccgtcacaatactgccggcgcgaatctgcgcgcccgcgtccatggcggctttacagtaggccatcgccagattaaggaagaattgatcggtgacgctcagaaaatccatcacttccgctatctgctgcttatcgtgttgcagacgggcgatatgcggcgccaacgtgcgcatcagcaatgcggaagaggcgatattgcgctggtggaattcatctcccatcgtaatgccctgcgccatcatcgcggtcaggtcaagcccccgctccagacgacccagcgccgcgcttaataccggcatcagcacatcgcgcatccagcgcaaacgttgctgaacatcttcgccataggcgccgaaacgcatcactttgccgatcccttcgttgagattgcagtacgcgcgattgccgtcggtgatattttccacgaccagcatcggcatactggctgacgtaataccgcccatcggccccacggcgttaacgtgatggcagggaataaagttgacctttccctgctctaacagcgcgagcgcgctcatttcatctttggcccatccttcaaacaggcatgcgccgatacaggcccctttcatcgggccggtcatctcttgccagcgcatcggcggcccggcatgaagaagcgttttcccctgattgagtacgctaattaatgaagaagctggcttcacatccagccagtgcggacgtgcgcgacgaatttgttcgatgactgcagcgttggcttgcgccactgatgtaaatatgggaaccccttattgcaaacgttctaacagacgagccagttttttattaccgccagcgacaggcgcccactggtagtgcaccacgggcataccggcagcctgtaaatccagcgcgaagctacgtaacccggcattaatcaccgctactgcttccagtaaccggggagctgatggatgagtagaagagagagtgggtcgaatcagttccgcggccaacagagtggcttcgggaagagaatccactaccgtgatgccggcatcttcgagcgcggcgatttgttgcgagcggcactgaggatcgcgttccgttccggtgacggttgcgatggcgaacagcggctggtcgctggcgcgtgcggcgcatgccttctgccaggcctgaatcagcgatgcggcgggatcggcggtcgcgccaaaaccaataacgacgtccactaataacacgcgtacctgcggttgtgcgccaagcccggcgataagctgattacgtaacgccgggtcaatcatcggatgtggtcgcccaacggtataaaagtcatcgcccagatcgataatctggtggccgtcagcgtcaagcatcatgccatggtgatgttccgtatccgtcgcgacgcccagatagccggccagcagtcccgccgcttccgccgccagcgttccgccggtatagagaccacgaatcacgccgcctgttgaaaccatttctttacgctgcgacgtcacgcgagacaataaacatgccagtcgggcagcttcatccagcgtcgaggcaaaccagacgttttcctcacgcgcaacgggagaggaaaaccctaagaacagcgctacaacgggtttcccggtggctttcatcgccgcgataatatgctgacgaaccgcatcagcaggcggtttggagacaaaggccagcacctggctcttttcatccgcgctgagtatgtccagtgccgttagcgcgctgatcccgccgacctcggcgctcaaatcgcgtccgccaagcccgatggcatgggtaatcccttcccccgccagcgcaatctgtgaacagagctcctgaataccggtgccggaagcgccaatcaccccgatgttgccctctggcatgacgttagcgaaagccagcggcgtattggcgatcatagcggtgccgcaatctggccccatgaccagcagtcccttatcacgcgcccggcgttttagtctgatttcgtcgtccagcgtgacattatcggagaagatcatcacgttcaacgaacgagccagcgcctgctccgccagttccgccgcatattcgccggccaccgataccagcgccagattcgcctctggcagtttctgacaggcgctttcccagcgtctgacctggattaacgactggctgccgctgcttccctgcgccaactgctgcaatgcttcttcgagctgtcgcacaatcacctgcgtaatgccgtcatctaccgcttcggtacgaatcgccacgcaaatgtcattgggcgtagcgccatgaaaatcgtcatgccagaaaccggtagtttccagcagcgacttattcgcaggcgtacccatcattaccgatacatcatcaacattttcggactcactcagctttcgagaaataatcattaagctgacagagtcctgaaaacacccttttttaataaaggcgtggatcataacaactccttaataattgcacccattgcaattgcacgagcagtgttaatgtgcgcttcacggtatatatccgggagggtaaatagagtgattaacgtcacatcaaatttattaacaaaagaattcaaacaacggctaaaggattagttatgattttctaaaaaagctttttatttaagcaaaaagataaaagccgcctgattatcaaataaattctaattatatttttttgcctgtctggatcacataatcattttattttcccggtatgttaatcgcagtcatgcttcacaccgtcgttaaaaaggaagacagatgaaaatcagtcgggaaacactccatcagcttatcgaaaataagctttataaagccggactaaaacgtgagcacgccgccatcgtcgccgacgtactggtttatgcagatgccagaggtattcactcacatggcgccgtacgcgttgaatattatgccgaacgaatttcaaaaggcggcaccaaccgggagccgacgttccgcattgagaataccggtccctgtacggcgatactgcatgccgataatgctgccggacaggtcgcagccaaaatgggaatggagcatgctattgaaatagccaaaaaaaatggcgtcgcggttgtcggcattagcagaatgggccatagcggcgccatctcttatttcgtccgccaggccgctcgcgaaggcctgattggtctgtctatctgtcagtccgatcctatggtcgtgccgtttggcggggcggatatttactatggcactaatccgctggcctttgccgcgccgagcgaaggcgatgacatcattacctttgatatggccaccaccgtgcaggcctggggaaaagtcctcgatgcacggtctcgcaatgagtccattccggagagttgggccgtcgataaaaacggcgcgccgacacatgatccttttgccgtcaatgcgttattacccgccgcaggcccgaaaggttacggcctgatgatgatgatcgatattttgtccggcattctgctggggctgccgtttggtcgccaggtcagttcgatgtatgaagatttacacgccggacgcaatttaggacaacttcatctggtcattaatccggcgttcttttcttcctgtgaattattccgcaaacatattagtcagactatgcaggaactcaattccgtgaagcccgctcccggttttaaacaggtttattatcctggacaggatcaggatattaaacagaaaaatgccgatatgaatggtatcgatattgttgatgatatttatcaatatctgatttccgatgccctctatctcaagtcatacgaaacaaaaaatccctttgcccaataattattgaaacaggaattttctatgataaagcattttcgccacgcgatagaagaaacattgccctggctctcttccattggagccgatcctacgggtggaatgacgcgtttactttattcgcctgagtggctggaaacacagcagcaatttaaaaagcgaatggcagaaagcggtctggaaacacgctttgatgacgtcggaaatttatatggccgcctttgcggcacacaatttccggagcaggtgattttaagcggttcgcatattgatacggtcgtcaacggcggcaatctggacggacaattcggcgcgcttgccgcctggctggcgctcgactggctaaaagcgacctacggcgcgccgctgcgcaccgtcgaagtagtgtcaatggcagaggaagaaggcagccgtttcccttacgttttttggggcagcaagaacatttttggcctagcgaatcctgaagaggtacgctatatccaggacgccaaaggcacaggcgttgtcgacgctatgcaggcgtgcggatttacccttcccgccgcgccgctcgctgcgcgaaccgatatccgcgcctttgttgaattgcatattgagcaaggctgcgttctggagagcaacggacagtcgattggcgtcgtcaacgccatcgtcgggcaacgtcgctacacggtgacgctcaacggcgagtccaaccatgcaggcacaacgccaatgggctatcgtcgcgatacggtgcatgccttcagtcgtatttgcagtcagtccattgaaaaagccaaacagcatggcgatcccctggtattaacgttcggcaaagttgagccgcagccgaatacggtcaatgttgtccctggaaaaaccacatttacaatcgattgccggcatacggacgccgcggtacttcgcgaatttaccgaacagttggaaaacaatatgcgcgccatctgcgatgaaatggatatcagcatcgatatcgatttgtggatggacgaagcgccggtgccgatgaacgccgaactggtcgcggccctcaccaggctgtgtgaaaccgaacaactgaactatcgcataatgcatagcggcgcaggtcatgacgcgcaaattttcgcgccgcgcgtccctacctgtatgattttcgtccccagcattaatggtatcagccataacccggcggaacgtaccaacattaatgaccttgctgaaggggtcaaaactctggcattaatgcttcatcaacttgcctggcaaaaataaggagccatcaatgggatatctgaataacgtcacgggttaccgcgatgatttactggcgaaccgcgccattgtgaaacacggtaactatgcgctcttaacgccggacggtctggtgaaaaatattattcccggctttgaaaactgtgacgtcaccatcctttcgacgccgaagctgggtgcttctttcgtcgattacctggtcaccttacatcagaatggcggcaaccagcagggctttggcggcgaggggattgaaacttttctctatgtcattgcgggaaatattgaagctaaagcagaaggaaaaacattctctttaactcagggcggctacctctattgtccaccgggggagatgatgacctttagtaacgctcaaacggaagacagccagctatttttatataaacgccgctatactcctgtcgaggggcatgccccgtggttggtttccggcaatgccagccagctggagcgtattcattatgaaggcatggaagatgttattctgctggatttcctgcctaaagagctgggcttcgatatgaatatgcatattctgtcgttcgaaccgggcgccagccacggctatattgaaacccacgtccaggaacatggcgcttatatcctttccggccagggggtttataacctcgacaacaactgggtgccggtgaaaaaaggcgactacatcttcatgggcgcttattccctgcaggccggatacggtgtaggtcgtggcgaagcattcagctacatctactccaaagactgtaaccgcgacgttatgatttaacggcgggcagccctcctgattatttttatttagctatgttggattttgccacggtgagaaccgtggatttttttatacttaacgagtcccgatgtcctggccaagtttgatgacgcgggcaatattacaggcgctgtggtagagattttgttcaccgttcgccagaacctccggcaaaggcgccagccgcggcaaaatactgaatactgcatcaataccgtgacgatggaccacttccacgccgtcgcccaatacgccggcaatgccgataaccgggacatgatgccgtttcgccactgatgcgacgcctatcggcgcttttcctcccgccgtttgcgagtcgattcgcccttctccggtaatcaccagcgaggcctcttttaccgcctcctccagcttcaccgcctgcataacaatctcaataccgggcttcatttccgcttccaggaagacgatagcggcaatccccattcctccggccgctccaccgcccggtatttgagacatgtcgcgtccggtcagggcatgtaaaatacgggcataattacgcaatccattttccagcgtctcgaccatttcaggcgtcgcccctttctgcggaccgaataccgccgccgcgccgcgtggccccaccaacgggttatcaacatcacaggcgacctcaatacgacactctgaaattcgcggatcgcgcccctgcaggtcaatgctcgccaggcgcgataaattgcccccttcggcgccaagcggcgttccctgcgcgtccagaaaacgcacaccgagcgcctgcgctactcccattccgccatccaccgtggcgctgccgccgatacccagaataatatggcgaattcccgcgtccagggcgtgacgaatcaattcgcctgtgccgaaactggatgcccgcagcggattacgcgcctcgggcgccaccagcatcaatccgctcgccgccgccatttcaataatcgccgttttgccgtcgccggtcaggccataaaatccgtttactttttcccccatcggcccgctaacgtccacagaaacccgtttcccgccggtcgcagccaccatcgcatccacggttccttctccaccatcggcgatcggtaaacaaacatagcgcgcatccggaaatacggttgaaaatcccgctttaatagcctgacagcatttatcagcgcttaagctctctttaaatgaatctggcgcaattacaatcttcattatgtctccttgttttctcacgttatttaatgcgttcccacggaataagattttccataagcactgccagtaggattcccaccagtaatccgttactaagcagaggacgaatcatcagtggaagatcctgtaaatagaccggaggaagccccatcaaaaaaatgccgacaaaaagcggtaacgccaggcgataaatattccgcgcggtaaacgtaatttgctggctaaaaaccaaaccggaataaagtaaaggtaaataagagaccagcataacggcgctgctgatcgccagtggaatagcgcaaaataagcgggttaacggcgttataatggcaaccagcagacacagcgcgctaccgcagataaaggatttgcgagaactgtcgccggtttgcgttaataaaccaatggaagatacaaaaggcgaaaaaggcacgaccgcaaaaggcaccgtcactaacgtcatcagtccggaaatcataaagcttcggcgataacgagaactgcccgacccttgatgcggataaaagatatcggtaccgcggatagcgccgtaagtgttgctgatgttgactaaccccgtcatcaccgccgtcacaataatacccggcatcagcgtgccgtggctgcccagcggaaaccatcgccagcttaattcacccggcggtaagtgtgacgaaggaaagcataaccgccatagcccccacccgaccacggtccctaccagtaacgcgtaacgggagatacgctgctgcaagaaaataatcatcgcgaggataaaacacatcaccgcgaccgccagcccaaagggggccaatttgattctggcgctggtatcggcaatgccaaaaggcagccccagcatgcctttaaaaaatattgaggtcagctgcgcgcccaaaagcagcatgaaaaaaaccattaccgccggcgtaaacaggcgagccagacggtgtcctaagccgctaatgccgataaatatcgtcaccatcgcggagatcgcgatcccgaccgacaggctggaggcgatatcgttcagcggcgtgccgcgagacgcctcgccaagcgtaatcgtaagtatagcgccccaccacaaccctgtcggcccttccataatggcgcggcgatggccgcaaaatgcctgaaccaggcaggccaacgcggtggtcagaaaagcgtattgtgtgagcattaacaggttatcagcgggaagatgaaaagcggacagcaaggtagggggaaccacaaccgtgttacagaaaataaagaaaaaccactgaaagccggacaatacactttcgcggttaataacagggaacatatccacaccttaaaatagagaatgcccgtcgtgacgacgggcattaaatcacaccggattactgctgatgtttaaggataaactgaccttttggcggcacagggaagccatgctcgatgtcataaataacatcgccgcgcaaaatcgttttggtaatacgcgcgccaatagtacggccaacatacggactgactttatggcgatattccagatcttcatttttcagaacatagctgctgtcaggctgaataaagaccaggtcagcatctttgccgggggcaatacgtcctttatgtttcagaccaaaaatatcggcggcgttggtcgccattaatttgccaaacatcggcaacgacataccgcgtttttgcaccgcttcatcaaacatgacgtccatgcagttttgcagtccggcaattccaccccatgcttgcatgatattgcctgctttcatttccggaggacatggagagtggtcggataccaggcagtcgatttcgccgttaaacagtttttcccacatccctttctggttttcctggtcgcgaattggcggagaacattttgccagggtgccaatctcttcgaactgatcggtatcgaggacaaaatagtgcgggcacgattcacaggtgacatcctggccttcctgacgcgcacgcgttacttcctctaccccctccgggctgctgatatgacaaacgtgcagacggcaacctgccgctttcgccagatacagcacgcgacgaatggcttccacttcagtaaataccggacgtgaggcgacataatcatgcgccgttacgcgaccttcgcgtttagcttcttcgcccagctcatcgcaaatcagagcattttcgcaatgtaccagtaccgtctggtccatctctcccagtttttgcgcgcctttgtaaaactgccagtcattaacgtcgcgaaaatcattatcgatgccacgatcgccgcaggtggcgacaaagcacttgaagccgacaacgcccacttcgtccagctcatgcagccgatccaggttataagagaccaaaccgcccaactgcgcggcgtcgatggtcaatttaccttttgccgcgtcaaacttgagttcaatcgtctcacgatcgaccgtcgccggcagctgattgagcggcatctcaatcatcgtggtaataccgcctttcgccgccgcgcgcgtaccggtttcatagccttcccagtgggtacggcccggttcagaaatgtgggtatgcgcgtcaaccatgcccggcgaaacgatcaatcccgtcgcatccagcacgtttttcgcttcccccaggttctcgccaatcgcggcgatttttccgccctggacggcgatatcgataactctcgcttcgttttctaagatgacagtaccgttcttaataattaaatcaaaagacataacaaactccttgtatggatacagatagtttttaaatagtgcacacttcattaaatacgcttaatattttttcaatagttaacctgcgactttttgctctcctgtattttcaaaacccgtgcgtttcttcagtagcgcataagcaacgaacgcaactattacgcctacaaaccaggacacgcgggataaaggctccataaatggtataaacttgccgcctaatgacagaatgactgcgaccagggtgactgaaaatgcagtcaggttaaatccattatcataatatttgtaatcaccgctggcggtgtatagctcatcaagattaatttttccacgcattaccacaaaataatgagctaacattacgccgattaccgggccaagcataccgccgataatatcgaggaacagataaatactgtcctgattctccattaatttccatggacaaatcagtagactgataatactggcaatcattacgccatttttatagttaagctttgtcggggtaagcgccgcaatttgataccccgcaggtataatattaccggtggcgttggttgaaattgtcgtcatcagaatcaccagcactgcaaagaatgaagcaaacaggctgtcccagcgctgcacaatatccagcacgttccaggtatccataccataatgaatactggctccggcaataatgcacacgctggctacggcgaataatatatacgctacgataagccccaatgtttgtcccaatgcctgagcgcgaaatgaatgcgcgttttgcgtgaaatcggacgcgctcaccgctggcgcagcccagacggcgactacggcgttaatcaccactaggaacagaaagccgctgtgctctgctttttgcacgcctgaaggcagatagtccaaaatcgggccaatgccgaccagcgatattgcccaaatagccatgccgccaaagacaatataaatacatggattgaggatagcggtaaatttatttaatactttaccaccgccaaaaccgatgccaacgttaatgatccaaaaaattagaaaagtaattagccctggcagtgaaaaacccagcagcttgaaatctccgcctaatgtctaaaatcctggccagatcttcccaattaaaataagaaatgccagcgatcccgcgtaacactgtaagccgaaccacataattgccgcgattccccctcgtaataatccagggaatagcgcgccgcggacgccgtaagaacctcgcaatatcatagcaaaaggaacgccatatttgctgcctgccgcgccattcattaccatcgccgccgcaataaataatgcgctgataataatggccaacatgatattaaatgttgatagccccagtataaaaaaaccgccgaccataacgtaatttggcacgttatgtacagatcccatccataaggtgaaatagttaaatgctttccagtttcgttgggtttctgttttaggtaataagtcttcgctataaccgcgttgctgatatagctctctttgatgttccataaatccctcttttcacgcatcggataacgttgttatgggtttagctatgaggaacaaataaatataaaataaagaaatagtagatataattatttttaagctgaagcaatacgttgcgttgctttctttttatataatgtgacagcagcaaagatcagcgttccggtaaccactaaacatgctgaaatcacaaaactgatctccttcgaccccgttacatccgaaataaatccggtcaacgttggggcgacaaccgctgaactcatgccaaagaaattaaaaaggctgaaagctcttcccagactttttgccgaagcctgttcagatacaaaggagatcaggatcgggtctactgccattttccctagcaagccgtatagcgtcaggctgaccatcagcatcgtggtattcggggacaaaaccgtaaacgccaacattgccgccgccacaatttccagaccgagaataaccttaactttactgttacggaatttatctgacagatggctaaaaaataacgcccccggtacgccaaccaccgccaccagagctgatgccagcccgatagctccgccatcaaatcctctttcagtctggagataagaaggcagccaggtcactatcaaataataaccgtagcaggtacagaaatagaggaagtaaacgctacacaataaaccagagaataaaggcgcgcgtttctcatcttccgtaacggtttgggtttgcttttccgcttgcgcagagtcgcttttggctttaccacgaatgaccagcgtaaagacgcacagcataattactaatatcgcggccacgatatacagtacattttgccaggccatgctcatgttttttactaatacgctggaaccgattaagccaatccccatccctatagccgacccgctgttgataatcgcgttggctaatgcccgacgggcctgcggcacgtttgccgaagagagtgaataagccgaactaaagaaagaagcgcatcctccgcctgccattagcgaccctgtatagatcatggccaggccattggctttcgcgatacagagtgtaccaataataaaaagcgtaaatccggccatcagcatgattttttgaccgaatttatcgaccaatattccgcaagggatttgcatactgcagtaagcaaaaaagtaaaaacttgcaatggcgcctatttctgcattacttacattgtctaaagatgcctgaatttctggataaattggcgtaagcacggtgcgatagatccaaatcgctacccagcccagactcattacgacaacaatttgtttccagtaatcaatcccggattttttagtttcactcatgttcttcacctttacagagtgttccttgtgaacaggtatcgctgcagccgcagcgatacacataattaggacaatttatgattggccattaattccagcgcctgtaccattgccgaatgatcaagctggctcccgccatttgccgcacaggtattgaataattcctggcaggtcgccgtattcggtaaattcagcgccagcgcttttgcgctttgcaatgcaagattaaggtctttctgatgaagcgcgattttgaaaccaggctcgaacgtccggttgatcatccgctcgccgtgaacttccagaatgcgtgaagaggcgaacccgcccattaacgcctggcgcacgcgtaccggatcggcgcctgcttttgaagcaaacactaaggcttcagaaaccgcttcaatattcagcgcaacaataatttggttagccaccttacaggtttgcccatccccattgccgcccaccagggtgatattttttcccaggatgtcaaagagcggtttaacgcggtcaaagactttctgctcgccgccgaccataatcgacagagtgccttcacgcgccccgatttctcccccggaaaccggggcatccaggtaatcagcgtccatttcattaacgcgctgggcaaaacgtttggttccgataggagaaatagaactcatatcgacgatggtttttccctgaagcgatgttttggcgcaaccgtgttcgccaaataacacctcttcaacctgcggcgtatccggcaccattatgaagatgatgtctgcgaattcagtcacctgacgtgcagtctcaacatttaccgcccccagcgagagcagttcgtccgcgactggaccaatagtcgtaacgtgtaattgatgaccggcgcgtgccaaattgatagccattggcgagcccataattcccaggccaataaatcccagtttcatatacaacctcttttattgctttcggtgtttccagattcaggcaacacaatccccttccaacacagtggaaaaaaaagcgctgcccgaattattctgcgttttaacggtactgattaatccacgataatcccgcttccgcggtagtcagtggtttatattcacatccaacccagccatcataatcagactgtttaatgacattaaaaataaagtcataattgatttccccggtccccggctcgccgcgacgcgggttatcagcaatctgtaaatggcctattttatcggcccatgccgtcatggtttgcgttaattccccttccatgcgttgcatgtgataaatatcatactgaattttgatattatcgctgccgatatccttaattaatactaacgcctgttgagtgccggtgagatggaatcccggcatatcaaagtgattaataggttcgataagtaataaaatgtcttctttcgccagcatatttgccgcatagcgcaggttttcgaccaacgtgtcgtagatctccgttgcggagaatcctgacggcgttttacccaccagacaatttattttcttattgcctaacgcgcgtgcatagcggattgcggccgctacgccatcgcgaaactcttcttcgcgcccaggaatacaggcaattccacgttcgccagccgcccagtcgccagccggtaaattatgtaacgtatgttccagattattatccctgagcttacgttttaacacttcgatgtcgtcatcgtagggaaacatgaattccacgccgcgaaatcccgactgcgccgctttatcaaagcgttccaggaaatcatattccgtaaacagcatagaaagattggcagagaaacgtaacatcgattacctcccttactcatatttcataaaacaggtttctgttggcgcatctttcgcactatccgcaacctcttcaaactcggttacgttatccagttcgtcgcccatggaaatattggttacgcgttccagaatgacttccaccaccaccggaacgcgatattgcgccatcagcgctttagcttgttcaaatgcaggcgcaatatcttccggtttaaagacacgaattgctttacagcctaacccttctgccacttttacatggtcaacgccatagccattcacttcgctggagttgatattttcaaaggcgagctgcacgcaatagtccatgtcaaatgcgcgttgcgactggcgaatcagaccaagataagcgttgttaaccagcacatggatatacggaatgttaaactgcgcgccgacggctaactcttcaatcaggaactggaagtcgaaatcgccggaaatcgccaccacattgcgttgtggatcggcagcacaaacccctaatgccgccgggattgtccagccaagaggccccgcctggccgcagttgatccagtgtctgtctttaaacacatgcagcatctgcgctgccgcgatttgcgacaatccaatggtggtgacatagcacacatcgcgaccaaaggctttgttcatctcttcatagacgcgctgcggcttcactggcacgttgtcaaagtgggttttacgcagcaaagtccgtttacgctgctggcattcgtccacccaggtcttccggcatggcaaacgccccgctttttgcatctcctgcgcgacatcgatcagcaacgttagcgccgctttggcgtcagaaacgatgcccagatccgggcacaacacgcggccaatttgcgtcggttcaatatcgatatggatgatttttcgaccctgagtatatttctcaacggaccccgtatgacggttggcgaaacggttaccgatgccaaaaaccatatcggatgccagcagagtggcgttgccgtagcggtgcgccgtttgcaggccgaccatccccgccattaaggggtgatcgtccagggtacagccccagcccatcagggtagggatcaccggtacgttgatcagttcggcaaactgctgcagcagtggcgcggcgtcggcgttaataaccccgccgcccgcgacaattaccggacgctcggactgaatcagcatctccagcgccttttcaatctgtactcggctggcggctggcttatataccggcagcggctcatacatatccggatcgaattcgatttccgcaacctggacatcaaacggtaaatcaaccagcacaggacctgggcggcctgagcgcatcagatgaaaagcctgctgtaatacgcgcggcaccagcgccgcctcacgaaccgtcactgccatcttgctgactggttttgcaatcgcttcaatatcgactgcctggaaatcttccttgtgcagacgcgctcgcggcgcctggccggtaatgcataaaatcgggatagagtcggcagaagcggaatagagcgcggtgatcatgtcggttcccgccgggccggaagtgcccaggcagaccccaatattacctgccgccgcacgtgtgtagccctcagccatatgcgaagcgccttccacatgacgcgccagtatatggcgaatgcctccatgcttacgcattgcagaatagaaggggttgattgcagccccaggaacgccgaatgctgtggtgataccttctttttccagcacatacattgccgcatccacggctctcatttttgccattttattgctacctctttttattggaaaaagtttccaacttttaaaaattttaaaaaagtcccgctccagcgagcgggatgcggctcaggctacagggggttttagcccaagcgccgtactgatgtctttcgcggtatcccgtaccagttcaccctggctgataaagcgatcttccgtcagccgggaagccggtcccgatattgagatagcggcgaccacgctgcccgcatcgtcatagatagcggaggcgatacaattcagcccgacaacatgttcttcctggtcaacggtatagccctgttcacgcgcccgctccagatttttaagcaggataggtaaatccaccaaagtggtcggcgtaaaccgccgcaaaccagtattgacaacgatccccaccagctcttcttcggtgagcgggtaaagcagcgcttttccggcgccggaagcatgtaacggcagacgactccctaagggcgcgcacattctgaccatcgatttgcactccttttgaccgattaacaccgcttcattaccgttgcgaatcgctacgttgaccgtctcgccagaaagcagcataagtcggtgcataaagggcccggccaccgagaggacatcgcgattatgaatatacgcagagcccacattaaatacgcctaaaccaatatgccaccagccaagctggctatcctggtacacaaaatcagccgcttgcagtacctttaacaggcgaaacgtcgtagaaagcggtaaatccaggctgccggaaatatcgctaactgatgaactgccgccgcttctttcgagatattgcaatatcgctatgcccctctccagcgcctgagcgcctttctgcgcagtcggctctgcctgtcctggcctgccgcgtcgtcttacttccgtcatatttacgttaactccggcccaaaatatgagcataaacaatgaacaatatgttcatcttatgcaagaaggccaatagcgtcacgcaaaacagagttcatgtgtcgggatactttcaacatcacagttatcgctgccaccgcgatccaccgtcagaaaatcggtaaccgtctgccacgcaaacagcgggtgatgccatacattacggtgataattgacgccctgccgtccattgctaataaacgcccgcagcgtggagagatcgggtttatcatcgccgagcgcgacaataacgacaaaagcctcgccgttcatcggcacaaacgcctgcgtacctaaaggatgacgttccagttcatgtaccacaataggcatcgcggctggttgcgccctgttaatactgatcagcgtgcgatcctgctccagaacttcaaccttcgccaggtcgtgatatcgctcaactaacccgttgtttatatgaaaaagtcacgttcctgcgtctcaataacatcgccataggcgctgaacgtcttctgatctaacggtaatacctcaagtttcattatttttcccttgtagctcgattccgtttaaccgcggtttggactctgtccggtttcaataccatgcaatctaaaaccttcgggatttaacatcaacataaaacttggaatatttttccaaaagtagatttagaccacaaatcaaacatggctattatgtaaaactacttaaaaatcataggaaaacaattctggttttatcaggatcgtaaggaggcgtctgacgatgtttgacccggaaacactgcgtacctttatcagcgttgccgaaacggggagtttctccaaagcggcggagcgcctgtgtaaaaccacggcaactactagctaccgcatcaaactgctggaggaaaataccggcgtagggctgttctttcgcacaacgcgaagcgtctcgttgacggcggcgggctctcaccttctctctcaggcaaaagactggcttgcgtggctggacagcatgcctgacgagctacgccaggttaacgacggcgtagagcgtcaggtcaatattgtggtgaataacctgctctatagcccgcaagcggtcgccagtctcttatcgtggcttaatgcgcgttaccctttcacccagtttcacttttcccggcaaatttatatgggcgtctgggattcgctcctgtatgaaggtttttcgctggcgattggcgtaactggcaccgagccgttggctaatacctttatgctcgaccctttaggttccgtacaatggcgttttgtgatgtccgcggatcatcctttagctcacgtcagcgggcctctaacagaagcgcagttgcgccgtttcccggcaattaatatcgaagacagcgcgcgtacgctgaccaagcgggtagcctggcgccttccggggcagaaggaaattatcgtgcctgatatggaaaccaaaatcgccgctcatctggcaggcgtcggtatcggttttgttccgcagccgctttgtcaaacgctgatcgacaaaaacgaactggtgagctgtaccatccctacgatgcgtccgccctcaccgttaagcctcgcctggcataaatttggcggaggcaaagcggtagaagacattgtgaaattatttacccaacgacaacccgaaatagccggttttttatccattttcaacacggtacgctgttaaaaatcaagccactttgcgaattggcgcgtaaaatagcgcaaaggatgatttaaggttacgttttacgttatgcaagacagacaaaaagcacaggactatcgcgcactcctccttgccgatacgcctttaattgatgtacgcgcgccgattgagtttgaacagggcgccatgccgggcgctatcaacctgccattgatgatggacgacgagcgggccgccgtcggcacctgctacaaacgtcagggcgcggatgcggcgttagcgctggggcatcggctggtttgcggcgacattcgccagcagcggcttgaggcctggaaagccgcgtatcaacgtttccccaacgggtatctgtgctgcgcacgcggcggtcagcggtcacatatcgtacaacgttggctgcaagaaacagggattgactgcccgcttattgaaggcggctataaagcgctgcgccagacagcaattcaggcgacctggcaactggcgcaaaaaccgatacttttaattggcggctgtacgggcagcggcaaaacgcaactggtacgacaacagcccaacggcgtggatctggaaggtctcgcgcgtcatcgcggctcctcttttggccgcacgctgaaaccccagctcagccaggccagttttgaaaacaaacttgccgttgaattgctgaaaattaacgcgcgtcagacgctaaaaaggtgggtactggaagatgaagggcgaacgatcggcgccaaccatctgcctgagtgtttacgcgaaagaatggcgcaagcccccattgcggtagtggaagatccgtttgcgcttcgtctggaacgactgcgtgaagagtatttcatccgtatgcatcacgacttcacccacgcctacggcgatggggccggttggcaggcatatagtgaatatcttcatcatggactgttcgctattcgccgccgtctggggttgcaacgctttgccgaactgacggacacgctggatagggcgctggcagagcaattatccagcggcagcaccgacggccatatggcatggctggttccgctacttaacgaatattacgacccaatgtatcgctatcaactggagaaaaaagccgcgaatatcgtttttcgcggcacatggcaagacgttgccaactggctaaaagcgcaatagcttatttttattgccggctgacgctacattgagccggcttagtgtctgtcgcgcttgtcggcacgttttgccagccagtcgcccagcatctgaacgacctgaaccagcacaatcagcgccactacggtaacaaccatcacttcggtttcgtaacggtagtagccatagcgaatcgccaggtcgcctaccccgccgccgccgacaatcccggccatcgccgagtagccgattaagcttaccagcgtaatcgtcaggccgcgcagcagccctgcgctggcttccggcaacagtacggtacagataatacgcatcggactagcgccgaatgccagcgccgcctcaataatccctttatcgacttcacggagcgcgctatctaccaggcgtgcataaaacgcgattgcggccaccgacagcgggacggaggctgcaatcgggcctatcgtattgcccagcaaaagctgcgttagcggcagtaacagcaccagtaaaataacaaatggcaccgagcggataatattcaccagaaccgaggcgacaagataaataaaacggttctgccagaacagatgacgatcggtgacaaaaatcagaaaaccgagcggtagaccgccaagaatcgccagcaccgttgaaatactcaacatctggaaagtttcattgaacgccagcgttaaatccggcaataaatcatccacggatcacctccacctgtgcagtacgttgacggatatgctccacggcggccgccaccgccgttggattatgcggcgcggttaattgcaccaccagaatgcccaacgcgcgttcgccgatatactcaatcttgccatgcaggatattgaccgcgacgccaaacttgatcgccacctccgacagtaccggctgctccgccgaatcgccgataaacaaaattttcagcaactgcccgggcaggtgttcccgtaagcgttccggcagggtcaaattaagggtatgagacaccagttgctgtgtgaaagcgtgttgcgggtgggcaaacacatcaaacacctcgcccgattccacaaccttaccgcccgacatcaccgccacgcgatcgcaaatagatttgatcacgttcatttcatgggtgatcagcacaatagtaatcccgagctgcgcgttgatctgtctgagcagggccagaatcgtggcggaagtttccagatccagagcggaagtcggttcgtcacacagcaaaacatccggatggttagcgatggcgcgggctatccccacccgctgtttttgcccgccgctgagctgtaccggaaaacagttcgctttatcggcaaggcccaccagcgttaaaatttccgccacccgcggcgcgattttgctgcgttcccagccagccgctttcaggctaaacgccacgtttttcgccactgtccgggtatgcattaagttaaaatgctggaaaatcataccaatacgctgccgcgcctggcgtaacgcttttccgtccagcgcagaaatttccacgccgttgacgttgacgcgcccctgactgggacgcgttaaggcgttcagggtacgcagcagagtgctttttcctgcgccgctggtaccgacaatgccaaaaatctcgcccgcggcgatatgcaggctcacatcatccaccgcgcgcgtgggggtaccgcgaccggcggtaaaatcgacgcagactttttctatttcaatcatattcacctcagaaattggggatggccaccgctgcgatcagggtgtcgcggtcatccattccggtttctggaaggcgctataaatattctttggatcgtcgatgaccgcgcgataagccggcgatttcaccgcctcgacaatatctttggcaaacggcttatcggcatcttcactgcgtaccgcaatgatatttttcagattctcatccaggtgttcctgcttaatcgcgctggagagatcgagtcctgccgccaccgcaaagttcccgttaaccagcgcgccggtcacgccgtccagcgtgcgcggtagctgtgcggcttccagcggtttgaaaaccagtccttttggattgctggcgatatctcgttcagaggctttggtcggatcgatattgtgcttaatcgtgataagccccaacgattgcaggaagcgaaggccgcgcgccaggttggtcggatcgttggagagggtaataatgtccccttttttaagcgcatccaggctgttgattttacgtgaatagaagcccatcccggcggtcggtaccacaataagtttgctgagcttcagccctttgtcagcggtgaatttgtcaaaatagagggtatgttgaaagaggttggcgtcgatgctgccgttagctaacgccatattgggctggacatagtcgctaaactcgcgcaccacgaccttataccctttttcttttaatgtcggcgcaatcgcctgcttcaccatgtcgccatacggccctggcgcgacgccaaatacgatcgtttgcggggaaccatcggcatgggcaaactgtaatccgcaggccagtaatagcgtgctggccgcaatgcgtaaactctgacgcaatcccataatttctccattttaaatagtgtgatgctgtgccggatgccgttcatgcggcatcgtctgttttggcccaaacgaaaggctatttcttaacatgacacagatcacagcctgctgtccttgaaattatttcatgatgtttcctggtgtgtcgttaaatgtacgaggcaggcgctcaggcgtgtgtcaggcgggaatggcgtaaagggaaatgccggataagacgtcttaacgccaacatccggcacaggaaaacgctttagaaatcgtaacgcagacgcaccaggttcatatcgcccagattgtcagtgctggaggtgaaaacatgttcataatcaacgcggaaaccataatccagttggaaggtgatccccacgccgttatcggtgcgcagatagtcgcggccattcacatattcaatgcggtcgcccataaagtacggttgaatagctttcacggcatactgaccaatcgggaaagcgtaaccgacaaaatattccagaccccacgcatcgccggcaaagtaatcattcacagacacttttttggtcgtcataaagttctgataccaaccgccgcctgcggcaatagtccagttttccggcgtccagcttaacgcggtaccgacaatattttgatcgtaagttttattgccgttgccgcgcatctccgcacgggtatagttccatgccgtcccccaggtcagatcgtcggtgagatggtaatccgcgcctaaagaaccgccgcctttacgtttgtaattcaggccgttattggcattataatcgtcgctgaacagataagacgcgtagagatcgacattgccaatgcttttcttatacttcaatgacttacgcgtacggtaagaaccatcgtagtcgccgttaatcccgttgcccggcgcctgacctatcatgtcgtaatcccagatatcggtttttacgcccaccacatcgtaataaatgctgttctgttgaccgaaggtcagcgttccccacgtcgcgctcttgaagccagtatacagcatacggcgagtggtatcagtcgtgcccttcgcataatggttatcccagtcaaataccgcagggatattgacgcccagctcgtaatagctaatccaactgatatcatcaaacagataataatccgcggcgaagcggaaacgcgtcccgccatcaaaaccattacgtttataaccgttcgcgccgtcattaccggtcatattctggaactgcggacgaatactcccgccaacggtgaaattgagtcggctgagtggattacccgcctggggatcttgttttaaaacggtgatttccgcctgagtggcgaaaggcatgaaagccactgccgcgccgatcgatgccgccaacgctgttattttaattgtcattatattttccttgatagatagccaatccaaatcatttagcaggcaaataataactgttataaaaccttacgtgttgtgtattttttaatgatttgtgctactaaaaatcaaggagttatcaatttgtgcgactaaaaaagtacgcgccgttttaaaaaccagcgcgaaattattcacatcatgaatcatccgctaaactggcggaatagcgctttgcctttaagcaaacgaacgccaagccagccgccgcatacggaaagcagcagcgcgccgcaaaacggcagtgcgacccataaacgccagtccggctcccaggggaaatcaaaaacgttgatttgtaagatcgccagcgccgtctccgcgccaatcgcggcgaccagcccggcaactaaccccagcatggcgaattcgcaccagagtgtggtacgcaacagtttctttccggctcctaacgtgcgccacaccaccagctcctgatggcgctgacgcatcccgacctgtacctgggccagtaatagcaacatgccgcagagagtgactagcacaaccatcacctccagcgcccgactgacctgctccagcacctgtcccacctgtttcaggatcgccccgatatctaacaggctgacggtaggaaactcgcggttaagctgcgttaacatgccgttgccattctcccagcgaaaactggtcaaccagctttgtggttgcccgtccagcgccccggaaggaaaaatgaagaaaaagttgggccgcaggctttcccagtccacttgacgcaggctggtgactttagcgctaaatgcctgggtatcgcccataaaggttacgctatcgccgagtttgacgttcagccgcttcgccagcccctcttccatagagacttcgcccggttttggcggccagtgaccggcgaccagcggattatgcgccgggcgcgtatcctgccaggtcaaattcagttcacggttgagcgactcatcctgctgaccttccgtcggattaccgtttatctccgttaaccgcgcccgcacaatcggataaaacgtctgcgggatcacctgatgttccgccaaaaaggctttcagcggcgcgacctgttctgaagcaatattgataaggaaatagttcgggctttccggcgggagctgctgttgccagcgatcaaggaggtcgccgcgcagcaccagcaagagcgccagcagcataaacgaaagcgaaaacgccgaaagctgactcaacgttgaccacggctgacgcagaagtcggctgacggccagacgcagcggtagcgacgtcaacgtcatgccgcgcaacacgttaagcagcatccagcccaccagaccgcacagcagcgccagtatcacggcgcccgccagaaccgcccacaacagcatactttcgcccatcaatccggcgagcagcgccaccacgacggcgcaggcgacaggcaaataaatttttaacgaccagacgcgagcgacaacatcgcggcgcagcacccgtagcggctggctcgccagcaacaatcgataaggccgtaaaccgaccagcagagagatgaccgtcatcgcgcccagcgcccacagccagggccacaggctggcgggcggcaaatcggcgggcaataccggttttagcagcaccagcaatatgttttcaaacagtaacccaatcgcgcctcccgtgacggcggaaagccccagcaccatcaaccactgtccgatgataagtttacgcaactgggcccggcccgcgcccaacgtttttaaaatcgccaccagatcgtagcggctacggcagtaatggctcatcgccaccgcgacggcagctaccgccagcagtagcgttaataacgccgaaagcagcaaaaactgctgcgaacgttcgagcgatttccccaatgccccgtcatcctgctccagtccgtaccagcgatgttccggtttaagctgcggtaacagccagctttcatagccagcaagctgttgcggcgttccgccgaatttataccgccacatcacgcgactccccggctgtatcgcaccggtttttgccacatcggccatattcatcatcagacgcggcgccatctgaaaagggttaaatccggaatccggctcctgcaccacttcaccagcaatacgcaaggtcacgtcgccgacatcaatggtatcgcccgttttcaaattaagcagcgccatcagacgcggcgccagcagtacgctacccggctgcggtttcactccgcctggacgggtttgcaattcgccgtacatcggataaacgctatctaccgccttcacgctggccagttgcggcgtatcgccggcaaacgtcatggtcgcaaaggttaactgctcgcccacgttaaggccgcgtttacgcgcctcttcaagccaggctttcggtacctcccgcgaactttgcagcgtccgatcgcctgccataaactcgcggctttgctgacttaaccctttttccatccggtcgctgatactgccgagcgccagtacgcaggccaccgccagactcaacgccagccagacaataatcagcgacggcgagcgccattcgcgccagaaccagcgggctatcatgcctcctcctgtaactgaccgttgaccaaccgtagccgccggtcgcagcgcgccgccagcgccgggtcgtgcgtcaccagaatcagcgtagtgccgtgctcgcggttaagcgaaaatagcaggtcggcgattttatctccggtctgacggtcaaggttgcccgtcggctcatcggcaaacagcacatcaggacgcccgttaaacgcgcgcgccagcgctacgcgctgctgttcgccgccggaaagctgtgccggaaggtggtcaagccgttttcccagtcccagttgttcgagcagcgctttcgcccccgccttactctgaccgctgttttcaccgcgtagcagggccggtagctcaacgttttccagcgcgttaagcgtaggaataagcatgaaggattgaaaaacaaaaccgacatgctgagcgcgaagctgcgcccgcgcctcttcgtccatctgatgaagcggtttcccgaccagactgacctctccgctactgccgtcatccagtccggcgagaatcgccagcagcgtagattttcccgatcctgattcgccaatcagcgcaatggtttcgccgcgtttgacaaccagttcaactccggtaaggatggaaagctcatgctcaccctgaccgacggacttcctgagacgatgaacttcaacactgttttccgctggcatttgcccttcctgtttttgatcctgttaactttccgtgccgccgccgcagacaccttattaattctgggcgatagcctcagcgccggttaccgtatgaccgccagcgcggcatggccgtcgctccttaatgataaatggcaaaacaaaacgtcggtcgttaatgccagtataagcggggatacctcgcagcagggactggcgcgtttgccggcgctgttgcaacagcatcacccgcgctgggtagtggtggagcttggcggcaacgatggcctacgcggttttgcgcctgcgcaaaccgaacagacgctacgtaaaatcattcagacggtgaaagccgccgatgcccaaccgttactgatgcaaattcatctgcccgctaactacggtcgccgttataatgaatcctttagcgccatttatcctaagctcgccaaagagttcgatattcctctattaccgttttttatggaagaggtatatctgaaaccacagtggatgcaggatgacggtattcatcccaaccgcgacgcgcagccgtttattgccgactggatggcgaagcagttgaccccttttctctcctgaatcattcgagttgcatgaaggcggcacgtaagagaatttccaggagcatagatacctatgtgactggagtaaacgaacgcacaggcaacttgaagtatgacggatatagttaaccacgactcttaaatcaacggagatcctgacaggtaaagttatgcaaaaatcggtcttaataacaggatgttccagcggaatcggtctggacagcgcgcttgaacttaaacgccagggctttcaaatcctggcgggctgccgcaaacctgatgatgtcgcccggatgaacagtatgggatttaccggcgtgttgatcgatctcgactcccctgaaagcgtggatcgtgccgccgatgaagtgatcgccctgaccgataatcgtctgtatgggatctttaacaatgccggctacggcgtgtatggccccctttccaccatcagccgtgaacagatggagcaacagttttccagtaatttcttcggcgcgcatcagcttaccatgcgcttacttcccgccatgttgccgcatggcgaaggacgcattgtgatgacctcatcggtgatggggctgatttccaccccagggcgcggcgcttacgccgccagcaaatatgcgctcgaagcctggtctgacgcgctacgtatggagctacggcacacaggcattaaagtgagcctgatagaaccggggccgattcgtacccgttttaccgataacgttaaccagacgcagcgtgataaaccggtagaaaatcccggcatcgccgcgcgtttcacccgcgatcctgacgcggtagtagcgaaagtgcgtcatgcttttgcaagcgataaacccaggctgcgctatcccgttacgctggtcacctgggcggtgatggcgctgaaacgcatattgccgggccggatgctggataaaattttacaaagctgagttgaagcgcgcccgtcagcccccatgtaaacgtgacacagacaaaagagagcgacgccatgtccgtacagaacattgtcaatattaatgaatccaacctgcagcagaccttagagcagtccatgaccacgccggtactgttctatttctggtctgaacgcagccaacactgtctgcaattaacgccagtgctggaaagtctggctgcccagtaccacggtcagtttattctggcaaagctggactgcgacgccgaacagatgatcgccgctcagtttggtctacgcgccatcccgacagtctatctgttccagaatggccaaccggtcgatggtttccaggggccgcagccggaagaggcaatccgcgctctgctggataaagtactgccgcgtgaagaagagctaaaagcgcaacaagcgatgcagttaatgcaggagggcaactacgttgacgcactgccgttactcaaagacgcctggcagctctcttcgcagaacagtgagattggcctgttactggcggaagcgcaaattgcgctgaaccgctctgaagaggccgaagcggtattaaaaactatcccgctacaggatcaggatacccgttatcaggggctggtcgcgcagatcgaactgcttaaacaggcggcggatacgccggaaattcagcaacttcagcagcaagtcgcggataatccgcaggatgcggctttggcaacgcaactggcgttgcagttgcaccaggtcggacgtaatgaagaagcgctggaattgctgttcagccatctgagaaaagatcttgccgccgccgagggacagacgcgcaaaaccttccaggagatccttgccgcgctcggcaccggcgacgcgctggcgtcgaaataccgccgccagttgtacgcgctactgtattaatcctctcttgcctgatggcgcgcttatctggcctacctgtcgtcctcaggccggataaggcgtttgcgccatcatccggcaactatcatgatttcttgagcggcatcactaccaactgatgacgcgaattatagaacttccggtaggttaaatagcaggcaatgatggtagacaggctggctgtcgataacagcataaacgttaccataatttgatatttaatcgcttttaccggatcgatcccggcaaaaatcagcccggacatcatccccggcaggctcaccagcccaacggtctttgccgagtcgatcgtcgggataagcgatgcgcggatgctatcgcggataagcccggcggaggccattttcggcgttgcgcccaaacttaatttttcctggatttgctgctgctcgctatgaaaacgcagccccagttggttgtagcacagccctaccgccaccatcgcattgccggcgaccatgccagcgatgggaatcacctgcatcggcgcaaattcaatcgaaccggtaagcaccagtaccgtcagcgttagtccggcgccgacggtgatggcgataaacgaggagagaaatgccttatcgatatatttactgcgcttttgcgcgttccatgcggcgttaaaacagatgaacagcaccatcagtagcgtcagggcggcatgattaacgccaaagatgtatttcagtacatagccgacaataatgagctgtatcaccgcccggcatacgctccacagaatatctttttccagcgccagcttttcctcgtgactgatgagcatcgcgaccaccaccagcagcatcgataacgccagcgaggtattggtaatattatgctcgttcataacgcgcctcctgcatctctccggcagatggcgttaacgttatcaccttatccgcgtgttgaatttcatctttatcatgcgttacccacaagacagcgacctgcttatcgcgaacatagcgatgaataatatcattcacattccgtttgttatgttcatccagcgcgctggttatttcgtcgagtaacagtattttcggcagaaactgtagattacgaattagagcaatacgctgtttttccccgccggaaagcgcggcaatcggtttttgcagaatcgtctccggcagttcaaaacgcgccagatcgtctgcgaaggctgtcggctgcgggcgctgatggcgaatttgccagggaaaaatcaggttatcgtaaaccgtatcgccgaatagcgctggcgtctgagcgcaataagaaacctgctggcgataggcttccggactcagagtagtaatatcccgcccctcaaaaagaatcacgccgatatcagggcttattagcgaggccaccattttcaacaacgtactttttccgcagccagaaggaccggtaattaacttaaattcgccgcgttgcagcgtaaaactgatgttattcactatttttgtcgtcgcagtctggtaaccgacctgctttaactcaagcaacatgctacgttttgtcatttattgcgcatccgttgttcatatttttatagcgatagtgtatccctgtaattaataaggggggaacatgctttactgaatcaggtataattcgcttaattcgtcagcaaaatcggtttatggacaacgcaacaggaggtttagctatgctcattcttatccctattctcattttcgtcgcgctggtgatcgtcggcgcgggcgtcaaaatcgttccgcagggataccagtggacggtggagcgctttggacgttacaccaaaactctgcagccgggattaagccttgttgtaccgtttatggacagaattggccgcaagatcaatatgatggagcaggtgctggatattccgtcgcaggaggtgatctcaaaagataacgccaacgtcactatcgatgcggtctgttttattcaggttatcgatgcgccgcgcgccgcttatgaagtcagtaacctggaactggcgatcattaacctgaccatgaccaatatccgtacggtgctcggttcgatggagctggatgaaatgctctcccagcgcgacagcatcaacgcgcggctgctgcatattgtcgatgaagccaccaatccgtggggaattaaagttacccgtatcgaaattcgcgatgtccgtccgcccgcggaattgatctcctcgatgaacgcccagatgaaagcggaacgtaccaaacgcgcctatatccttgaggccgaaggggtgcgtcaggcggaaatcctgaaagccgagggggaaaaacagtcgcagattctgaaagccgaaggcgaacgtcagtccgctttcctgcaggcggaagcgcgcgaacgttccgccgaagcggaagcccgcgctacgcagatggtgtctgaagccatcgccgccggggatattcaggcgttaaactacttcgtggcgcagaaatacaccgaagcgttacagcaaatcggctcggcgaataacagcaaagtggtcatgatgccgctggatgccagcagtctgatgggcgctatcgccgggatcagcgagctggttaaggacagcgccagcgaacggaaaaaagcatgatagcgatgattctggtacatccacatatcttctggcttagcctcggcggcctgttgttggctgcggaaatgctcggcggtaacggctatttgctgtggagcggcgtggcggcagtgattaccggcttaaccgtctggctcttaccgctcggctgggaatggcagggcgtgctgtttgcggccttaacgttgctggcggcctggctttggtggcgctggctggcgcgtcgcgtgcgggaacaaaagccgaccgacagccgccttaaccaacgcggacaacaactggtaggccgccggtttatgcttgatgccgcgttagtgaacggacggggtcatatgcgtgtcggtgacagctcgtggccggtatgcgctgacgaagacctgcgcgcaggtacgcatgtcgaagtgatcgccgtggaaggcatcaccctacgcattcgcgccgtttaatcaacgtaacttttgcgccttgtgatgacagcagccggaaagattatcaataatcgggcagtcggcgctgtcatcgccgggacaactctccgccatcgccaacagttgatcgcgcattgattgcagctcgctgatatggcgttcgatctccgcgaccttttccagcgtccgctttttcacatctgcgctatggcgtcgcggatcgttaaacagattgaccagttcgccacactcttccagattaaaccccacctgcctcgcctgtcgcagcaacgtcagctcgtttaaatgcttctgcgtgtaggtgcgataaccattttcgctacgtaatggcggcgtcaccagccctttctcttcataaaaccgaatggctttgctggttaaaccggtttttttcgccacatcgctaatattcatatttcccccttgaccttaaccttgctggaaggtttaacctttatcacagtgagtcactacgattactaatgtcaatgaattgatgaccaatcataaaggagtttttactatgtctcaaactatcgacctgaccctggacggtttgtcctgcggtcattgcgttaaacgcgtgaaagaaagtcttgaacaacgtccggatgttgagctggcggacgttaccgtaaccgaagcgcacgttaccggtaccgccagtgcggacgcgttaattgaaaccatcaaacaagccgggtatggcgcgacgttaagccacccaaaggctaaaccgctgacggagtcatcaatcccgtcggaagcactggcagcggttcctcatgagcttccggtagcgacggccgatgaagaaagccaacagttgctgttaagcggcatgagctgcgccagttgtgtcacccgcgtacaacatgcgctacaaagcgtaccgggcgtcacgcaggcacgggtaaacctggcggaacgcactgcgctggtgatgggcagcgcgtccgccgctgatttagtgcaggcggtggaaaaagccggctacggcgcagaggcgattgaagatgacatcaaacgccgcgagcgccagcaggaaaccgccatcgccaccatgaaacgttttcgctggcaggccatcgtcgccctggcggtcggtataccggtcatggtctgggggatgatcggcgataacatgatggtgaccggcgacaaccgcagcctgtggctggctattggcctgatcacgcttgcggtgatggtttttgcgggcggtcacttttaccgtaacgcgtggaaaagcctgctgaacggcacggcgacgatggatacgctggtggcgctcggcaccggggtcgcctggctctactccatgagcgtcaacctgtggccgcagtggttcccgatggaagcacggcacctctattacgaagccagcgcggtgattatcggtctgattaatctcggacacatgctggaagcgcgcgcccgtcagcgttcctcaaaagcgctggaaaaattactcgatctcaccccgcccaccgcacgcgtcgtaacagaagacggcgaaaaaagcgtcccgctggcggacgttcagccagggatgctgctgcggctcactaccggcgatcgcgtgccggtggatggcgaaattacccagggcgaagcgtggcttgatgaagccatgctgaccggcgaacctattccgcagcaaaaaggcgaaggcgacagcgttcatgccggcaccgtcgtccaggacggcagcatcctgttccgcgccagcgcggtgggcagtcataccacgctgtcacgcattattcgcatggtacgccaggcgcagagcagtaaaccggaaattggccaactggccgataaaatctccgcggtattcgttcccgtagtggtggccattgcgctgttcagcgccgctatctggtatttcttcgggccggcaccgcaaattgtttatacgctggtcatcgccaccaccgtactgattatcgcctgcccttgcgcattaggcctggcgacgccaatgtcgattatttccggcgtaggccgcgcggccgaattcggcgtgctggtacgcgacgccgatgccctgcaacgcgccagtacgttggataccctcgtttttgataaaaccgggacgctgacggaaggcaagccgcaagtggtggcggtaaaaacctttaacggcgttgatgaagctcaggcattacgtctggcagccgcgctcgaacaaggctccagccacccgctggcccatgcgattctggaaaaagccggcgatgataaactgccgcaggtgaacggtttcagaacgctgcgcggactgggcgtcagcggtgaagcggaaggtcatcaactgcttctggggaaccaggcgttactgaacgaacagcacgtcgccacggatgatatgacggcggaaatcaccgcgcaggcctcgcaaggctcgactccagtcctgctggcgattgacggtaaagcggcggcgttactggcggtacgcgatccattgcgcagcgatagtattgccgcacttgaacgcctgcacaatgccggataccgtctggtaatgctcaccggggataacccaacgacggctaacgcgattgccaaagaagcgggtattgatgaagtgattgcgggcgttctgccggatggcaaagccgatgcgattaaacgcctgcaaagccagggtcgtcaggttgcgatggtcggcgatggtatcaacgatgcgcccgcgctggcgcaggcggacgtcggtatcgcgatgggcggtggcagcgatgtggcgattgaaaccgcggcgattacgctgatgcgccatagtctgatgggcgtggcggatgcgctggccatttcgcgcgcgacgttgcgcaatatgaaacaaaacctgcttggcgcatttatctacaacagcattggtatcccggtggccgccggtattctgtggccgtttaccggtaccttgttaaacccggtagtagcgggcgcggcaatggcgctgtcttccattaccgtcgtcagcaatgccaaccggctattgcgctttaaaccgaaagcgtaaaaagtctatacccaaaataattcgagttgcttaaaggcggcaagggagtgagtccccaggagcatagataacgatgtgactggggtgagcgacaaatctgccgggagcagatttgaacgtcgcgtgcgacggcccgtcagggcgaggcccatggatgggccgagtaatccgtagccaacacataagcaacttgaagtatgaagggtatatatcaggcagcatcagctgcctgatatattattaagccatcagcaatttaccgtatcaatatataaaaatttaaccgcacatcctatagaaaaataaaaacaacattttataatgtttttttgaatcataaggatgtgttatttatgtttagaaaagcagttacgcttcttttcctgctttctcccgcagttagttatgcaggattatttgattccactccagagttaaaatgtggcaacgataatgcagtcacggcggcaaaagagtggatttacaatgaagcattaggtcgtttacagcaagactatattaaagagccctccacgcttttcttcgatatcccccagactcaatacgagcagcaactccgggctattcctgttcaattcagtgatgtaatcacgcagaaccctcaaccagaaaatgccaacctacgaacttgctcggctaccgtcgccatgagtattcctcagccattgtttaaattaatgaaagacttaccaaatactctattctatatttcacaaggggatggacaggtaataaacaatacggtgacctggaaacaggttaactacaatattcagctagcagacaacaataaagatattgttgtcacccctgtgcagaaaaccgataaattggcgcggtctatttatgtaatggcaagaatgacggtatctggtgatagcattataaagaaaaaaaataactcactgattgaaatcgcagcaaagaaatttgagagtagagatcgcgagcttaatcaggtctggaattcgctacccacctctgcccgaacggcattaaaacaagagcagcgagtctgggtgacaaaaaaagagcaacagtgcggcaaacttagcgatgcaaaatccgaggacatacctgctgaaaagcgcatcagtatttataaatgccagcttgaaatgaccatcgccagaacgacctatctcgacggcagcgaactacccgactgatcgttgacgtcccgtcagggcgcattgcgcccttttctccaacgcgctagcatgagctttttcaaagggagcgcgtatggagctattaaatcaacttaaacgtttatgccgcgcgctgcgtggtaccccaaatagttggcctgctatcgatctctccctgcccggcggtcgtcatctgcatctggttggcagtattcatatggggacgcgcgatatagctcctcttccagcaaagctggtgaaaaagctacgccaggccgacgcgctggtcgttgaagcggatatttccggtaacgaaacgccattcagcaatctccccaaatgcccgccgttggtcgaacgtctcagcgccgggctgctaaacacactggaaaaacgggtcagcgagttgggtatgccgctgatccattttgataatcaacctttatggcagatagctatggtgctacaggccacgcaggcgcaacggctgggattgcgcccggactatggcattgattatcagctattacaggctgcccgcgaaatgtcgctgccggtgcaagagctggaaggggcgaaacaccagctcgaactactatgcgatctgcccgatggcgggatggcgctgctcgacgacacgctgacgcactggcacaccaacgcacggcttttgcaggtgatgatcggctggtggcttgaacagccgccgaccagcatcggcgcttcgctccccagaacgtttagccaaccgctgtatgatgtactgatggtgaaacgcaatgaagcctggcgcgacgcgctgctggcactgccaccgggacgctacgtggtagccgtaggggcgctacatctgtacggcgaaggcaacctaccgcaaatattgaaataaaaaatggccaatatcgctattggcccgtcaaagaggaatttcatcgttattattatcccgacgctttcgcttcggatcttcagattgtcgctcaaagttgccgcaactgccaagacctaatgcacaagattatactattttttagtccgctttcgggcgtatgctgatggcaaatcacgtctgtagtaagaaggaacgttatgacacccgcagttaagttactcgaaaagaacaagattccgtttaacattcacacctacgatcacgatccgaatgaaactaactttggcgatgaagtggtgcgtaagctcgggctaaacgccgatcaggtgtataaaacgcttttggttgccgtgaatggcgatatgaagcaactggccgtcgccgtgacgcctgtagccgggcagctggatttgaaaaaagtcgccaaagctctgggcgcgaaaaaggtcgatatggccgacccgatggtggcgcaacgcaccacgggatacctggtcggcgggatcagtccgctgggacagaagaaacggctgcctacgctgattgacgcgccagcccgcacgtttgccactatttatgtttccggtggtaaacgcgggctggatattgaactggcggctgacgatttggccgccatcctgagtgctaaattcgctgatatcgcgcgtcgggattaagcctgcgtaaaatacattgccggatagcggcgcaaacgccttatccggcctacagcatacataatccgtaggccttaaggctgtgcgccatcaggcagagatggctatcagtaccgctacagccagttcacctcgccatttggcgtaaacgccgccgcatccaacggtgaattctgctgaataaactctttcagcacttccgcgtcaataaacccggtattcacgtagcccggtttgttatcgatgcgcggataaccatcgccgcccgtggcgttgaaactcagcgtcgccatgcggtaggttttggccggatcaacaggctcgcctttgattttcagatcggtgagcttgccctctttggcgacaaagctcacattggcgaactgtggataggcgccggagtccggtttcatctgcgctacggcggtgagataatcaaccacctctttgccgctcatatcggcatacaccacaatgttgccgaacggctgtaccttgagcacgcttttataggtaatatctcccgcctcaatcgagtcgcgaataccgccgccgctcatcacgccaaaatcggcaccggtgcgcgcgatctgcgcagccagaatcacccgtcccatattggtctggacaaatctgaccttactgcgatcgccttcaagcaggccattcacgctaccaattttcacctccagttgcgctttacctttattctggaacggcgttaataacgagagcatttgcggattttcggcgatttccggcgtgtaaagtacacgctcgcttttcccgttatcccaggtcacttttttcttgagatttaccggaataagctggtagttaaccattttcatctcgccgttacggaattcgaaatccgcgtggcccacatatttaccccactcatgcgcctgcacgctccagatgccattttgcttatccggcgcgcagggcgttcccgttacgtaattcacctgtttttattttccgacgccatgcataccgggtcttgtgagtgaccgcccacaatcatcgccagcgaaccggcaggcagactacgcgccatctcaacgtcgcccggcgcattcgaaccgtgatcgccgttgtcataatgtcccatatgcgtggtcgcgataatcacgtccggtttttcattcatattaagttcctgaatcaccacctttgcttcttcagcaggtttacgaaactcaatatcggtgaaatattccgggttgcctattttcgccgtgtcatcggtggttaagccgattaccgcgatttttatatcctggcgtgtaaaaatagcccacggcttaaacagacgctcgccggtacttttttgataaatattggcggaaagaaagggaaacttcgcccacttttcctgctggcgcaatacggtgagcggattatcaaattcatgattaccgacggccatagcgtcgtagccaatcagattcatcccgcggaaatcgggctccacatcctggagatcggattccggcactccggtattaatgtcgccgccggataacaacaggacgcttcccccctcttgcgccacctctttacggatactgtccaccagcgttttttgcgccgccagaccatattcgccatattcgctgcgccagaagtgaccgtggtgatcgttggtatgcaggatagtaattttataggttttatctttttcgtaagcctgtgcaggctgagtcgtcagcgcgaacgccgccagtaacgccagcgccacaccccgtttcaaaaatttcatctttctctccctgactcaatatcaaccgcagaaattacctttccttgcaataatagacaaatatgttttcagaattgagacttccttcaaacacatttcacaggtatgttaggcaagtaataattacacatcctactatctccaacatcgcataaaatttaagtgactttctatggccatgagtgaaccaacccagccgttagccggcgcgcccgcagcggccgctaaagcacgtacttcgtttggtattttgggcgcgatcagtctttcccatctgctgaacgatatgatccagtcgctaatcttagctatttatcccctgttgcaggcggagttttcgctgactttcgtccagataggtttgatcaccctgacgttccagctcgcctcatcgctactgcaaccggtcgtcggctactggacggataaatatcccatgccgtggtcgctgcctgtcggcatgtgttttaccctgagcgggctggtactgctggcaatggcgggaagttttggcggcgtattgctcgctgcggcgctggtgggtaccggctcgtccgtttttcacccggaatcgtcccgcgtggcgcgcatggcctccggcggacgtcatggtctggcgcagtctatcttccaggtcggcggtaacttcggcagttcattgggcccgctgctggccgccgtgattatcgcgccctatggcaaagggaatgtcgcctggtttgtgctggccacgctgctggcgatcgtggtgctggcgcagatcagccgctggtatgcagcccagcaccggatagcgaaaggcaagccaaaagcgataatcgctaacccgctgccgcgcaataaagtcgtgctggcggtcagcgtgttattgctactcattttctcgaaatatttctatatggcgagcatcagtagctactacaccttttatctgatgcaaaaattcggattatcaatacaaaacgcgcagctccatctgtttgccttcctgtttgcggtggctgccgggacggttatcggcgggccggtgggcgataaaatcggcagaaaatatgtgatttggggctctattctcggcgtcgcgccgtttacccttgttttaccctacgccacgctgtactggacggggattttaacggtgattatcggctttattctcgcgtcggcgttttccgccattctggtgtatgcccaagagctgctgccaggacgcatcggcatggtttccggcctgtttttcgggtttgccttcgggatgggaggcctgggcgcagcggtgctggggctgattgcagaccataccagtatctatttagtttataaaatctgtgcttttctgccgcttctggggatactgaccatattcttacctgataatcgacataaagcatgattttatggcggttaaaggtatgctttaaccgcctgtacatcctgatgccatcttgctttgtccatcccatgcttatcacttttacgttccatgctctttttgccttcagatcgtatctttttataaaacacaaccattttttataaacatcctgattgaaattgtcataaactattacccggagttttggagtccagcaaccaaaggagacggaatgcatcacgctaccccgcttatcgccaccattgtcggcggccttgtgctcgcttttattctcggcatgattgccaacaaattgcgtatttctccactggtgggatatctgttagcgggcgttctggcgggaccttttaccccaggttttgttgcggataccaaactggcgccggagctggcggagctcggcgtgattctattgatgttcggcgtcgggctgcatttttcgctgaaggatttgatggcggtaaagtctatcgccattcccggcgctgtcgctcagatagcggtggcgacgctgctgggtatggcgctttccgccgtgctgggatggtcattaatgaccggcatcgtttttgggctctgtctgtctaccgccagtaccgtcgtcctgctgcgcgcgcttgaggagcgacaactccttgatagccagcgcgggcaaatcgccatcggctggctgattgtcgaagatctggtgatggtgctgacgctggtcttgctgcccgccgttgccggcatggtggaaaaaggcgatgtcggcatagcctcgctggcagtcgatatggggataaccattggtaaagtggtggcgtttatcgccatcatgatgctggtcggacgccgcctggtgccgtggattatggcccgcagcgccgccaccggctcgcgcgagttatttaccctttccgtactggcgctggcgttaggcattgcgtttggcgcggtagaactgtttgacgtctcttttgcgctgggcgcgttcttcgctggaatggtgcttaatgagtcggaactgagtcaccgggcggcgcacgatacgttgccactgcgcgacgcctttgccgtcctgttttttgtttccgtcggcatgttgttcgatccgctagtcttgattcaacagccgctggcggtgttggcgacgcttgccattatcgtctttggtaaatcgatcgctgcgtttttcctggtgcgtatgttcggccactcgccgcgaaccgcgctgaccattgccgccagcctggcgcaaatcggtgagttcgcctttattctcgccggactcggtatggcgctcaatctgctgccgcaggcgggacagaacctggtgctggcaggcgctattttgtcgattatgcttaatcccgtactgtttaccctgctggagaagtatctggcgaaaaccgaaacgctggaagagcaaactctggaagaggctatcgaagaagagaagcaaattccggtggatatctgtaatcatgccctgctggtgggttttggccgcgtaggcagtctgctgggagaaaaattactggcggcggggattccgctggtggttatcgaaacgtcccgtacccgcgtggatgaactgcgcgaacgcgggattcgcgccgtactgggcaacgccgctaacgaagaaatcatgaatctggcgcatctggactgcgcccgctggctgttattgaccatccccaacggttacgaagccggtgagattgtcgcctcagcgcgagaaaaaagccctgatatcgagataatcgcccgcgcgcactatgatgatgaagtgaaatatattaccgagcggggagccaatcaggtagtgatgggcgagcgagaaattgcccgggcgatgctggaactgcttgaaacgccgcccgcgggtgaagtcgtcgccagttaagggtttgccggacggcccgatgcgcgcagcgccatcgggcaagccagattagcgatcccagtacgactcttccaggctgtcctcacgttccggcagcccgcgtgtcagacgcggagaatgctggttcagtacctgataactgacacggttagcatatttacacacctgcgccagcgacgaataggtcagccaggtgaatttgtgcttactggagttcggtacgttgctacgatggtaactgttcgccgtaatatcgtgcagcagcgccgccagcgcgccatcgcccgcgccgttggtgttcatgattttttccggcccgcccatatacggcgcaatatgcgaataaacgcgcagcggattagtacaatctttatggcgcattgcccggctaaattcatactggttaaattcagcaatagcccccggcagcagaggatgctgggttttacgttttgcttcctcttcggtgaagcctgccatatataaccctatcggcccggcggtgcataacaccaggtcgacccagtccagcgccttatccgccgccagcagcgggtcgttttcgccggtcagcgcttccgcttcttcttcattcattgccagaatcgagacattctctttgagaaacgcctgccaccactgcggattatcggcgatcacaaatttggtgcccagcgtcatgacaaccggcacgttatgctttttcgcgtattcgatcgctttcatcgtcgcgtcaggcatcggttcgccaggcttacagcgcaccagatatgaggtcaacaccagcgcggaagcgccagcgatcaccgcttccggaatactttccgcccgtagctgattcatatggccggggctgatagcgaaggtacgctcgccggattcgccaatcagcgtgaaacagcggccaatcggaccatctaccgcttgcagataattcaggtcggtacggctggaagtattacacaggtagcgataagcgtagctgccaatctcaatgttgctgcacatcacgcccagtaacaccgaacggtcatccgccagtaccgagtaattatgcatcgtattgcctatggtgccgccagcaaactgatgggtgatcagattttcccgcgtcagttcctgatacagcttctccgccaactcgtcttctatcaccagagaatgcccggcgcttaatccatagcgtgtaataaaatcgtcatccactttcgcctcaatatccaccaacgtctggtcgataccgacgacccaggaggcgttggtttcctgttctggctgaatttgttgcaacaacgggtcacgcgcattgacgggaaaatagtgtttggatttacgtttaccgggaaatttcatgattgtgcttacggatgaataacggagcgctgcatggtagcacattccccctgctgcgcgcgacggacgatggcgtttcaatatcggacgacgagatcgcagtttctccagccgcgttttttacaatggttcactttcacaaggagcgttttatgaagccggaaaataaaattcccgtactcacccgactgtctgacgaaatgacagccgtcgtaaacttccagcaaccaggccttcccccctggcctgccgatggcgatattgagacccagcgtcagtattatcttcttgagcgccgtttctggaatgccgacgcgccgtccatgaccacccgcacctgcgccgtctctacgccttatggcgatgtaacaacccggctctactcgccgcagccgaccagtcaggccaccttatactatctgcacggcggcggatttatcctcggtaatctggatacgcatgaccggataatgcgtctgctggcgcgttataccggctgcaccgtgatcggtattgattattcgctgtcgccgcaagcgcgttatccgcaggccattgaagaaaccgtcgcggtatgcagctacttctctcaacatgccgatgaatactcgctcaacgtggaggaaatcggtttcgccggagattccgcaggcgccatgctggcgcttgccagcgcgctctggctacgtgataagcacattcgctgcggtaacgttatcgcgattctgttgtggtatgggctgtatgggttgcaagattcggtaagccgccgtctgttcggcggcgcgtgggacggcctgacgcgtgaagatctggacatgtacgaaaaggcctatctgcgtaacgatgaagatcgggaatcgccctggtattgtctgtttaataacgatctcacgcgcgatgtgccgccctgctttattgccagcgcggagtttgatccgctcattgatgacagccgcttgctgcaccagacattacaggcgcaccagcagccctgcgaatacaaaatgtatcccggcacgctgcacgccttcctgcactattcgcgaatgatgacaatcgccgacgatgccttgcaggacggcgcacgcttctttatggcgaggatgaagacgccgcgttaacggtacggcgccgtgagtttcagtatcatatcaatatgttccggcgtcgcgttcagcgcctgaatgtacgcatattttttaccgcccgcttcaaggaaaatctcgcggttctgttccgctatctcttccagcgtctccagacaatccgcggcaaaccccggacacatgacctgaatatggccagtccccttttcacccaacatttttagcgtttcatcggtgtacggcgtcagccacggttcacggccaaagcgcgactggaacgtcatcattaccttttccggcggcagtcccaatgcggaaaccagttcacgcgtggtatcgcgacagcgctgcgggtagtcatcgccttcatccgcataacgttgtggaatgccgtgataggagagcagaagtaaatccggctcgccgtgtctggcgaacgactcacgcgcgcttttcgccagcgcatcgatataagcgccgtcatccgcgtaatcgcgaataaatgagatcccgggaatacgacgtttacgcgccagtatccgccccagttcgtcccagactgcgcccaccgttgagcaagaatattgcgggtacaacggcagcacgacgatatggtcgacgtcgcttgctaacagttcatcgacagcgctttccagcgagggcgagccgtagctcatccccagcgcgacgggcgtgtctggcaaccgcgcggccagcgcctgttgctgttcgcggctatataccatgagcggcgaaccgccatccatccagatagattgatagagtttcgcgacgcgcggcgaacgcagcggtaaaataacgccacgcagcagcggccaccacagcagacgaggagtatccaccacgcgtctgtcgcttaaaaattgtttcaggtagcgctttaccgcttcaggagttggggcatctggcgtgccaaggttagccagcaggataccggttttcgtctgacgcattgccgcctcttatctattcaaattgttgataattgtagcggaaaagcgataaagaagaactaattgctgcgagaggtaagacgagaatttgccgaatggcgctaacgataccggtaggccggataaggcgttcaggccgccattcggcaccgattgcctgatggcgctacgcttatcaggcctgcgggataatggcaggcctgataagcggttcactacgcgaaaaaaattaaccgaggattttttccagcgctgcgcgcacgtcggcaacggcctgcgtaccgtcaactttagcgtatttggtgttgcccgcttccgcttctttctggtagtagccaatcagcggcgcggtcatctgatgatattccaccagacgtttgcgaacggtctcttcctgatcgtctttacgggtcgtcagatcttcgccggtgacgtcatctttgccttccactttcggcggattaaacttaacgtggtaaacgcggccagaggcggcgtgtacgcgacgacccacaatacggtcaacgatcagttcgtccggtacgtcgaattccagcacgtaatccaccacaatacccgcttctttcatcgcgtcagcctgcgggatcgtgcgcgggaaaccgtccagcagaaaaccgttacggcagtcttcctgggcgatacgctctttaaccagcgcaatcaccagttcatcggtcaccagtttaccggcgtccatgatatctttcgcctgtttgcccaactcggagcctgatttcactgcggcgcgcagcatatcgccagtggagatttgcggaataccatatttctccatgatgaactgagcctgagttcctttacccgcgcccggagcgccaagcagaataatacgcattacgaaaatcccctcaaaggttgtcgatattttttaaaaagcgctaaacgataccaccatcacgcatttcgctcaaggaagtcgcctgatgctgaaacggttaacgaagagaaatccagaaaagagaaggtattataaaaaatgccggatggcgctgacgcttatccggcctacaaacagtactcgtccgtaggccggataagatgcttcgcgtcgccatccggcagtcacaaaacagtactcgcccgtaggccggataagacgcttcgcgtcgccatccggcagtcacaaaacagtacccgtccgtaggccggataagatgcttcgcgtcgccatccggcagtcacaaaacagtacccgcccgtaggtcgggtaagacgcttcgcgtcgctatccggcaatcagatgagcgttatcaggacaccagcaactggttcatacggcggataaactggttcggatcttccagcgtaccgcgttcagcgaacagcgcctgatccagcagcagctcgacccactctttaaactgcgcttcatccttggtatcggcagtgcgtttgaccagcacatgatccgggttgagctcaaagatgtatttcacttccggcacggactgaccggccgcggcgaacagtttcgccatctgggtgctcatttcatccgcatcggtggtgacaatcgccggcgtgtcggttaaacggtgtgtcagacgcacctctttcacgcgatcgcccagcagggttttgacacgctccacgaacggctcaagcgccttttccgcttctttcgcgttttcgtcgacttcatccgccagtttttcgatggactcatcggctttagcgaccgactggaatgctttaccgtcaaactcggtcaggtagttcatcatccactcgtcgatgcgatcggagagcagcagcacttcgatgcctttcttacgcagcagctccaggtgcgggctgtttttcgccgccgcatagctgtctgcggtgatgtagtagattttttcctgcccttctttcatccgggagacgtaatcttccagcgacacggtctgggcggaagagtcggtatgggtggaggcaaagcgcaacagtttagcgatcgcttcctggttggcgtgatcttccgccgggccttctttcaacaccagaccgaactgtttccagaaggtttggtatttttccgcgtcgtctttcgccagtttttccagcatttgcagaacgcgtttggtcagggcgctgcgcagattacgcgttaccgtgctgtcctgcaggatttcacgggagacattcaacggcaggtcattagaatcaatcaggccgcgcacgaaacgcagatagttcggcatgaactgctcggcatcgtccataatgaacacacgctgtacgtacagcttcagaccatgtttgtgatcgcggttccacagatcccacggcgcctgcgacgggatatacagcaggctggtgtactcctgcttaccttccacgcggttgtggctccaggtcagcggatcggtgaaatcatgcgcgatgtgcttgtaaaactcgttgtactcgtcgtctttaatttccgacttgttacgggtccacaacgcctgggccttgttgattttctcccaggaaatcacggtttcgccgtctttttcttcccgtttttcaatctctaccggcaatgcgatgtgatcggaatatttactgataattgagcgtacgcgccagtcatcgaggaattcatcttcgccttcacgcaggtgtaaggtgatttccgtaccacggtcatttttggtgatatcggcaacggtatattcgccttcgcctgccgattcccagaacacgccattttccggcttgtcgcctgccgcacgggtacgtacggtcactttatcggccacaataaacgcggagtagaagcctacgccaaactgaccgatgagctggctatctttcgcctgatcggaccccattgattcgaggaaagatttggtgccggacttggcaatggtgcctaagtggtcaatcacctcatcacgattcatccccacgccgttatcggcaatggtcaacgtacgcttatctttatcgaaagagacgcgcacacgcagctcgccatctccttcatacaggtccgggtttgacagagcgcggaaacgcagcttgtccgccgcatctgaggcgttagagatgagttcacgcaggaagatttctttattggaataaagagaatggatcatcaggtgcagaagctgtttaacttctgactgaaaaccacgcgtttcttgtcctttcatgtggatagacctcaacaatgccatttttaatggtaaaaatacgttgagggtgagatggggacaagcgggtgtgatttcaagcggaggccgcgaacgccgcctccgtttgttcagaaaataatcttatggcgtcccgccagcgagtgggacagcgtcgtaccgtcgaccatctccagttcgccgccaaccggcacgccgtgggcgatacgactggcttcgacgccggcctccgcgcacagctcggcaatatagttcgcggtagcctccccttcaaccgtcgggttggtcgcgaggatcagctcgctgattttttctgacgccagccgctgttccagacgatcgagaccgatatcatccggcccgatgccgtccagcggcgacaggtggcccatcagcacgaaataccgcccggaaaattgcccggtctgctcaatggcgtagatatccgcaggactctccaccacgcaaatctggccgttttcctggcgccgcgggttcgaacagatattacaaacatcctgctcggtaaaggtgcggcagtcggcgcagtggccgatttccgacatcgcccgggtcagcgcctgcgccaggcgcattccgccgctacgatcgcgctgcaacagggtaaacgccatccgttgcgccgacttagggccgacgcccggaaggcagcgcaacgcttccataagctgagttaacagcggactggtttgcatcagaatggcatcttaaagcctggcggcagttgcataccggaagagacggaagccatcttctctttttgcgtctcttcaatgcggcgcgccgcatcgttgaaggccgcagcgaccagatcttccagcatctctttgtcatcttccagcaggcttgggtcaatttccacacggcggcagttatgcgcaccgttgatggtaaccttcaccagacccgcgccggattcgccggtcacttccagctgcgcaatctcttcctgcattttctgcattttttcctgcatctgctgggcctgcttcatcagattgcccagaccgccttttccaaacataagctctctctcttgatggttcacaatcgcaagccgggcttacgatcaaatggggcggatactctcttcatccagctcggcgtcgaagaatcgacgcagcgtctgaatgttattatccgcgataattgactcacgcgcttgcgcgagtttctcttcataaatggcctgacgccattccagcggcgtacgcaccgcgggattatcatcttcaacgatggtcagttcaaccgtcgttcccgtcagatcgctgagcgcttgcgccagcttttgctgcgcaccgctggaattgaggtgccgctgcgtcgagcgcagatgcagacaaaccgcgttgccgttctgctccttccaggcattgagcgccacctgctccaccagcttaggcaaagaaagctggcttacctgcgccgcccacggatcgcgctcaatcgcttccgccgccagtttagccgccagctccggcgttttttcatgctccagagctttcttaagcgcttttggcgtagccaccacttctttggtttgcactaccggcgtggtggccttccagcgataagcctctttctttactggcgtcgtttccagcgcagacggcgccgggcgcgcctgtacgcgctccgaaaccgaggccagccgctccagcgcagagttattcaccggccgcgcgcgggatgcggctgccggttcactcttttttgttttggttactccctgcgcgcgctgtagctgattgcgcgccgccagcacctgactggtagacgccggcagcggcgctggcgatgtctgcggcgcgggcgccgacggctgctgcacctgcggcggcgtcattaccgccgttggggccacgggcgcaaaagactgccgcggcgtttcaggctccggcaagggcatacgcgggtgaaacgccagcgcacgcaataacgtcatttcaacgcccatccgccggtccggcgcccagggcaattctttgcgaccaatcaacaacgtctgataatagagctgaagatcgccgggaggcaccgtccgggcaagttcgcgcatccgttgctcgatagccgccatatcgctgcctaacgcggcaggcgaaagttgcaccatcgcaatacggtgcagcaggctaagcatttcgaccagcagcgcttcccattcaataccgcgcgccgccgcctcgttgataagcgacatgacgcgttcgccgttagcgtcaaccactgcctcgactaatgacaaagcctggtcgtcgtccagcgtaccgagcatggcgcttaccgcctgcgtcgaaacctgcccgtcgccactggcgatcgcctggtcagtcagacttaatgcatcgcgcaggctgccgtcagccgcgcgtgataacaactgcaacgcgcggggttcgtgagcgatatgttcctcattgagaatatgctcaagctgatggcgaatctgttcaacatccagcgctttgagatgaaactgtaggcagcgcgacaaaatggtcaccggcagcttctgcggatcggtggtcgccagtaaaaatttcacatgcgctggcggctcttcaagcgttttaagtagcgcattaaagctgtggcgcgacagcatgtggacttcatcgatcagatagactttaaagcgaccgcgcgcaggcgcgtactggacgttatccagcaggtcgcgggtgtcttcgactttggtacgcgatgcggcgtcaatctcaatgagatcgacaaaacgcccttgctcaatttcccgacagttatcgcaaacgccgcacggcgtcgcggtaataccggtttcgcagttcagccccttcgccagcagtcgggcgatagaagttttaccgacgccgcgcgtgccggaaaaaagatatgcgtgatgaatgcgccctaacgacaagccgttcgccagtgcggtcagcacatgttcctggccgacgacgtcagcaaaggtttgtgggcgccattttctggctaagacctgataactcattggcaggctctgaaacgctggaaggtggattcatagaagggtaatgctaacacaacctcgccgatacagcgaggttgtctctctggctaaaatagcagtgcgaatagcctgaatcaatgccctggaaacggcatcaggctataacaggtaatcccctgcttttccagacgctgctcgccgcccagatcgaacaaattgatgatgaacgccgcatcggtgactttcccgcccagacgacggatcagcttcacggtcgcctcaatggtgccgccagtcgccagcagatcgtccacgaccagcacgttgtcgccaggtttaatcgcgtcgacatggatttccagctgatcggtgccgtactctaattcataggtctcggcaatagtttcacgcggtaatttgcgcggtttacgtaccggaacaaaaccaacgcccagcccaagcgcaaccggcgcgccaaacaggaagccacgcgcttcggtgccgaccactttggtgatacccgcatttttataacgctcaactaacagttcaatactgagcgcgtaggctttcgggtcttccagtaagctggtgacatcacggaaaagaatgcccggtttcgggtaatcctgaatgcttttgatgctgtttttgagaaactcaagctgctgtgcagtcgcggtcatggatatatgcctgctaagtacggtgttactcacggcgcaatacttttcagtcaggggtaacgctcggttactctttgaccgcctgcgcctgtgctcgaaaacggtcgaatttactggctgtgaacgacaattgcaacagcgattcgtgtgcttcagcgcttttgttgcttttcatcaatcaccggtatccgccacataaaaatcagcaggcaggccaaaataaccaacagcagcacccgcacccacatcatattcaccagccacagcgaaataccaaaggtcagcaatatcaacgcgatcgctcgcggtttcgctcccggcggcatggcccgatagcgctgccagtggcgcagataaccgccaaaccatgagcggtataacaaccaagcatggaaacgcggcgacgagcgggcgaaacaccaggctgccagtaaaatgaacggcgtagtcggcaacaggggcaaaaccacgcccagtgtccctaatactaccgccagccagccaatgatgattaaaatagtacgttgcataatgcgaatcgttatcaaacagaaggctactgtagcacagcctgtcttattttcatcggggtgttgaattgaaaaccgctatgctgttacagacgctggaagagaagctggcgacgctacgccaacgctgcgcgccgctggcgtaacatgcgacgttaagcgcgcgctttgaccgacaccttttccgtacccgcagtactctgttgcagggatatctggaagaggcagacgccaatctcgccgcgttgcgtcaggcggtaaaacatgagcaactgccgcaagtcgcctggctggcggaacatctggcttcgcaactggaggcgatatcgcgtgaaaccgccgcctggtcgctgcgccagtgggatgccgccgcaccagggcttggccgttggcagcgcagacgaatacagcatcaggagtttgaatgtcgactgctggcgatgacacaggagcgcaaaattcgtctggcgcaggcgaccggccttgtcgaacaacaaacgctgcaaaaggaagtcgagatctatgaaggacggctggcgcgctgccgacatgcgctggagaaaatagaaaacgtactggcgcgtttaccccgttaacccaggagaaagtatgtcgcttgaaaatgcccctgatgaagtcaaactggccgtggatttaattgtgctgcttgaagagaatcgcttaccggcacgaacggtgctacgcgcgctggaaatagttatgcgtgattatgaaaacaagttaaaaagtacggaagacgactcgcaaacagagtaatagccccctggtttgtcctcgttgtcgctgacaaagtggtcgctacagtcaggcaacaaaggacggggcatggaacgtctacccaccacgccgcacgatgcggtattccgacagatgctgatgcaaaaagaggtcgcccgcgactttctggctatccacttgccagaagactttcttgcaatctgcgatctggattcactgaagctggagtcggggagttttgttgaagacaatttacgcagccgctattcagatattctctactctctgcatacccaacacggccccgggtatgtttacgcgcttattgaacatcagagcaaatcagaccggctgatggcttttcgcctgatgcggtacgccattgccgccatgcagcgtcatctggatgccggccatgataccttgccgctggtggtaccaatcctcttttatcacggtccggaaagcccgtggccctatagccttaactggcataatatgtttgtgaaaccggatatggcgaaagccttatacagtcatgaatttgcgctggtcgacctaacgataatgccggataatcagcttttgcagcatcggcggatagcgatgttagagctcctgcaaaaacatattcgtcaacgcgatttaagcgaactgctcgacccccttatcacgcttttaacgcaggatcatttgacggacgcgcagctcagtgtgctgatcaactatatgttgaaagcaggaaacgccgcagaacccggggcgctaattcgtcaactggcgcagggcgcgccgcagtataaggaacaactgatgacaatagcggaatggctggaagaaaaaggccgaacggaagggttgcgaaaagggcttgagcaagggttggcacaaggccgtgaggccgaagcgcgcgctattgcccgcaaaatgcttgccaacgggctggaacccgggctcatcgccagcgtcaccggcattacgccggaagagctttctacgctttcgcattagcggcgccgcgcgcactcataaagcgcgcggcccaccgccttttagcttgccgccggcgccagatcgccgccgttgagatcgcgcttcacttcagtgacttcgtcgcccttcgcgttatgcagatgcacctcaagctggttaaaggcaatattgatatcattttcacggcacagtcgatcgatcgcgcggttcagttcatccaccgtatggctacgatcacgcaattcacgcacatacagacgcagttcatgatccagagtgctggcgccaaaggtggtgaagaatacggcaggttccggatcgtgcatcaccttcggatgctccatcgccgcctgtagcaggactcttttcactttctccagatccgagccataggccacgccaagccggatcaccagacgtgtcgtggtatcggagagggaccagttaatcagccgctccgttacgaacgctttgttcggaatgatcacttctttacgatcaaaatcggtaatagtggtggcgcgaatacgaatcttactgaccgtgccggagtaggtgccgatcgttaccgtatcgccaatgcgtaccggacgttcgaagaggatgattaaacccgagacaaagttaccgaagatctcctgtagcccaaaaccgagacctaccgacaacgccgccgccagccactggagtttatcccacgagacgccgagcgatccgaatactgtcatcgcgccaacagcgataatgacgtagttaaggatcgtggtgatcgcatacgaagccccttggcgcatattcaggcgtgaaagcaccagcacttccagcaggccgggtaagttgcggatgagcgcccaggccaccatcgcggcaataatggcaaatagcaagctgcccatcgtcacgcttttcaccaccgcagcgccagcttcggagccgttgtagtgccacagcgtgatgctatcaagatagctgaatacggtgatcaaatcggaccaaatcgcccagaacataacgccaaacagggcaagcattagcagcatcgtgatacgtaatgtttgctggttaatttgctccaacgcgatggtgggttcttcctgtggttccgccccttccgctccctcttttaccaggttctgacgacgagccagcgcgcgtcgccaggcaatccggcgcgccgctacacttaacccgcgcagcaccgtttgataaagcaggttccagataatgaccagatagacggtttcaatccagcgccccgccaggcgcagggtggtatagaaatagccagtcgccgttaataccattaacgccactggaataatggaaagaatcgtcacggtcaccagtcgaatgccgtgagattctttatcgcgccagctttcccggcacagtggccacaccagcaatgttatgaccagcagattgaggaaaataaccgcctgccccagcacgtcatccatcagattcagcggcgacaactccgccaccacagaccaaaagtgcagcggcagcaatgcgaggctaatgcgtacaatctggcgacgccagtggctggtcaactgcgccggcataccaaaatggcgtatcgccacgccttctttttccagcaccttccagcacagcccaaagaccagccagaacatcgcgagctttttactaaaggcccagagcagatcgctgatatttagctgcatggtcagcaggatcaatccaatcgcgaggataatcaggcacaccggcagcgcgcggatcagatcgatcagaatagcttttggcgtattgagctgactatcgttacgcagcgatcccacggcggcggccagcttctgttgatacgcttttaaccatttcagacgccagcggattaaaccggcgatgagcaagagcggcaacccggccaaaaaagcaataaatactgcgggccaggctttttgccagttcaccgtgattttcatggcgctgaattgctcttttaacgtttgggggaacgctttaagccagtcccagtccatagggcggttactgttcacccaaaaaatctgctgcgtcagaatggctttcagatttttcgagacgctcatcaactgctgctggttaacttgcaggttaatcgccatcatcagctggttacccaactgtttatttagctgatccaatagctcacggcgcatctccaccacctgaagcaacgcatcatgaacttcatcattcacctcgctggtatgcccctcctccagcttgtcgacaaaggcatcgctttggaataaggcatcacgctgctggttgatttcaaactgctccagacgcaaatccgcaatgcggttggtcatatcttcgagttcgtcggcggagggcagggtttgctgctgttgataaagaatacgcgacagcaacaggctgccttttaagacggcaatctgttctttgatatttctttccgactgcagagcgcgatcgagccagttttttactttaatgttttgctgcatcaacatattgccgttttcggtcgcgacaatcagacgctggctgagttgatggttaatatccagttcctgttttaccaacgggttcgcctggatacgcgccgtttcgtccggcgaaatagcctcctgggccgttttttccgttagcgtaagtcgtttactgttgaccgcctcctgtaaaagttgaagctgatgttcaaggcgattactgttggccgtcacgtaatcccgctgtttttgcagggtgtcctgcaaaacggtattcccttcaagactcttacgttgctggtcgatctgcgcattaagcagcgcctgttgtgcctgtaataacacctgttggctggggcgaagcgcggcttcgccgacgttattgccgtccagacggttacggatttgctgtatttgctgtgaggcggtatacatggcgttttgcacgcgctccggctgggtttgtagcgaaacaagctggctgttataagcggcaagatcgttttgcgagttttgcaaatcatccagtacctgcgccacgcgcagctcaagctgacgtagcgaaagcgcactcagcgtttttcgcatttcatcatcattatcgacatcgctcagcgcattcaacgcagccgtcgcctgacgcattttttcaggcgcctgcgccaccttctgccgtagctgtacggtctcctcttttacccgctcgattttctccagcgtagctaacgtatcaataaggtcttgctggacgagcttatcctgggcggagagatctttttgcttattcagcgtatccagctggttttgcacatccgcttttgacggcaggtcgccattcgtttgcccccgggcaaacgccagagactgacaggacagcaggataataagaacgctaattgtaataaaaacaaaatgctgtgaacgtttataaagctgcaacatagtcatgagaatgaagtgtctgaaccggcaagcagaccggaaataattgagtcgcaagaatatcacgcctgtaacaaacagaatagcgacacagaaaatgtccaggagttttcctggaatattatcagggggagccgttgaccgtcgacgcgcgcagcgtcggacacaattgatacatctccagcaggatcgtgacgtaggcgcgagcttctttttttaaatcaaacgattgcggagcaaataaccagttttccatgagccctgaaataaagctgcgcatcagtatcgccgcacgacgggtcagcagattttcaggcagcattttagcattaatacaatgttttaacgtttgttcaatccgatcgtaactttccagacaaaggctacgttgcgcctgttgaaccacaaccatttctccgacaaactcacatttatggaatataatctccatcaataagcggcgtcgttcttctgttacagtagcttcaagaatatgaactaaaatttctcttaatacagatagtggatcgtcggggaattttgcctgatactcaatctcaagctcaccaatattggattctgatagctcccagatctcactgaataaatccgacttatttttgaaatgccaatagattgcgccgcgcgtcacgccagcagcgttcgcaatctccgccagcgaggttgccgatacgccttgctgcgagaacaaacgcagggccacatccaggatgtgttgtcgtgtctccagcgcttgttgtttggtttttcgtgccatatgtcggtgaatttacaggcgttagatttacatacatttatggatgtatgtaccatagcatgacgataatataaacgcagcaatgggtttaaggacctttgaccattgaccaatttgaaatcggacactcgaggtttacatatgaacaaaaacagagggttaacgcctctggcggtcgttctgatgctctcaggcagcttagcgctaacaggatgtgacgacaaacaggaccagcaaggcggccagcagatgccagaagttggggttgtcacactaaaaacggaaccactgcaaatcacaactgaacttccgggtcgtaccgttgcttaccgtatcgccgaagttcgcccgcaggtaagcggcattatcctgaagcgtaatttcgttgagggaagtgatatcgaagcgggagtctctctctatcagattgatcctgcgacttaccaggcgacttacgacagcgctaagggcgatctggcaaaagcgcaggccgccgcgaatatcgctgaactgacggtgaagcgttatcaaaagctgctgggtacgcagtacatcagtaagcaggaatacgatcaggcgctggctgacgcgcaacaagcgactgccgccgttgtcgcagcaaaagccgccgttgaaaccgcacgtatcaacctggcgtataccaaagtcacctcaccgattagcggtcgtattggtaagtcgtccgtaacggaaggcgcgctggtacagaacggtcaggcgtcggcgctggcgacagtgcagcagctggaccctatttatgtcgatgtgacccagtccagcaatgacttcctgcgcctgaagcaggagctggcaaatggttcgctgaagcaggaaaacggcaaagcgaaggtcgatctggtgacaagcgacggtatcaaattcccgcagtccggtacgcttgaattctccgacgtgaccgttgaccaaagcaccgggtctattactttgcgcgccatcttccctaacccggatcacaccttattgccaggaatgttcgttcgcgcacgtctgcaggaagggacaaaaccgacggcattactggttccacaacagggcgttacccgtactccacgcggcgatgccacggtgctggtggttggcgctgataacaaagtggaaacccgccaaatcgtcgcaagccaggcgatcggcgataagtggctggtgactgacgggttgaaagcgggcgaccgcgtagtcgtcagcgggctgcaaaaagtacgtcctggcgcacaggttaaagtgcaggaaattaccgcggataacaaacagcaagccgcaagcggtgatcaacctgctcagcccaggtcttaacttaaacaggagccgttaagacatgcctaatttctttatcgatcgccctatatttgcgtgggtgatcgccatcatcatcatgttggcaggggggctcgcgatcctcaaattgccggtagcgcaatatccgacgattgcgccaccagcagtgacgatctccgcaacctaccctggcgctgatgcgaaaacggtacaggataccgtcacgcaggttatcgaacagaatatgaacggtatcgataacctgatgtatatgtcctccaacagtgactccacggggaccgtacagatcacgctgacctttgaatccggcaccgatgcggatatcgcgcaggttcaggttcagaacaagttgcaactggcaatgccgttacttccccaggaagtacagcaacagggcgtgagcgttgagaagtcctcaagtagcttcctgatggtagtgggcgtcattaacaccgacggcaccatgacccaggaggatatttcggattacgttgccgccaatatgaaagatccgatcagccgtacctctggggtgggcgacgtccagctgtttggttcgcagtatgcgatgcgtatctggatgaatccgacagagctgaccaaataccaactgacgccggtcgacgtgattaacgcgatcaaagcgcagaacgcccaggtcgcggcaggtcagctcggtggtacaccgccggtaaaaggccagcagcttaacgcatcgattattgcccaaacgcgtctgacctcaacggatgagtttggcaaaatcctgctgaaagtgaatcaggatggctctcaggttcgtctgcgggatgtagcgaaaattgagcttggcggcgaaaactacgacgtcatcgcgaaatttaacggtcagccagcgtcaggtcttggcatcaaactggctaccggcgccaacgcgctggataccgctaccgctattcgcgccgaactgaaaaaaatggaaccgttcttcccgccagggatgaaaatcgtctacccgtatgacaccacgccgttcgtgaagatctctattcatgaagtggtaaaaacgctggtcgaagcgattatcctcgtgttcttggtgatgtacctgttcctgcagaacttccgcgcgacgttgattccgactattgcggttccggtggtgttgttgggaacctttgccgtgcttgcggcattcggtttctcgataaacacgctgacgatgttcgggatggtgctcgccatcggcttgctggtggatgacgccatcgtggtggtcgagaacgtcgaacgtgttatgacggaagaaggccttccgccgaaggaagcgacgcgcaaatccatgggccagattcagggcgcattggtgggtatcgcgatggtactgtcggcggtatttattccgatggccttctttggcggctcaaccggggcaatttatcgtcagttctctatcaccatcgtatcggcgatggcgctgtcggtgctggtcgcgctgatcctgacgcccgcgctgtgcgcgacgatgctcaaacccgtcgccaaaggcgatcatggcgaagggaaaaaaggctttttcggctggtttaaccgcctgtttgataagagcacgcatcactacaccgatagcgtagggaatattctgcgcagcaccgggcgttatctgctgctctatctcattatcgtcgtcggtatggcttatctgttcgttcgtctgccaagctctttcttgccggatgaagaccagggcgtattcctgacaatggtccagctccccgccggcgcgacgcaagagcgcacgcaaaaagtgctggatgaggtcacggattactatctgaacaaagagaaagccaacgttgaatcggtattcgccgtcaacggcttcggttttgcagggcgcggtcagaataccggtattgcatttgtgtcgttgaaagactgggccgatcgtccaggcgaaaaaaacaaggttgaagcgattacccagcgggcaaccgcagcgttttcacaaattaaagatgcgatggtcttcgcctttaacctaccggcgattgttgaactgggcaccgcaaccgggtttgacttcgagttgattgaccaggcgggacttggtcacgaaaaactcacccaggcacgtaatcagttgttcggcgaggtggcgaaatatcctgatctgttggtcggcgttcgacctaacggtctggaagatacgccgcagtttaaaatcgatatcgaccaggaaaaagctcaggcgctgggcgtgtctattagcgacattaataccacgctgggcgcagcatggggcggcagctatgtaaacgactttatcgatcgcggtcgtgtgaagaaagtttacgtgatgtccgaagcgaaataccgcatgttgccggatgatattaacgactggtacgttcgtggtagcgatggtcagatggtgccgttctccgcattctcctcttcccgctgggaatatggttcgccgcgtctggaacgctataacggtctgccttcgatggaaattctgggtcaggcggcgccaggcaagagtactggtgaagcgatggcgatgatggaagaactggccagcaagctgccgtcaggcattgggtatgactggaccgggatgtcctaccaggagcggttgtccggcaaccaggcccctgccctgtatgctatctcgctaatcgtcgtcttcctgtgtctggcggcattgtatgagagctggtctatcccgttctccgtaatgctggttgttccgcttggggttatcggcgcgctgctggccgcgaccttccgcggactgactaacgacgtttacttccaggtgggcctgctcacaaccattgggttgtcggcgaagaacgcgatacttatcgtcgaattcgccaaagacttaatggataaagaagggaaaggtctggtagaagcgatgctggaggccgtccggatgcgtttgcgtccgattctgatgacctcgttagcgttcatgctgggggttatgccgctggttatcagttccggcgcgggttccggcgcgcagaatgcggtaggtactggcgtactgggcgggatggtaacggcaaccgtactggctattttcttcgtaccagtcttcttcgtggtggtacgccgccgctttagccgtaaaagcgaagatattgagcatagtcattcgacagaacatcgctgatttgctcactgttgataaggccgcgcaagcggccttttttacgcaaaaatcataaaatacgcttattgttagattgattattttttgccatattaataaaaggtataatccttactgcgttaaaggcttttcttaggaaagttggccatttcttaattcagccattaattaagaaatattaagaatattcctagctattttctcctgtcagagtctattgttttagcctgaaaagctaaaaaacgttaacccaatgattatacgagcaataaaactggttcctttttaggcgaccgacgttcactgttaaaattcgaaaaagtatggcgacacacggctttcacgcaattgtaatttttagtaatatgacgatgaaaagttttttagagtagattatagttaaatcataaggtgacgtgggaagtaccaggttagttagttgtatccatcccgaaggtgttcggttagtttaagccactaaaaaggggatgcattatggacgaatactcacccaaaagacatgatatagcacagcttaaatttctttgcgaaaccctgtatcatgactgtcttgcaaaccttgaagaaagcaaccatggctgggttaatgacccgacctcagcagtcaacctgcagctcaatgagctgatagagcatattgcaactttcgcgcttaattataaaattaagtacaatgaagacaataaattgattgcgcagatagatgaatacctggacgacacctttatgttgttcagcagctatggtattaatacgcaggatttgcaaaaatggcgtaaatcgggcaaccgcctgttccgttgtttcgtcaacgccaccagggctaatcctgttagtttgtcttgttaaaaattattacaatcataggtagaatttatgtctgataaaccattaactaaaactgattatttgatgcgtttacggcgctgtcagacaattgacactctggagcgcgtcattgagaaaaataaatatgaattgtccgacaatgagctggctgtattttactcagctgcggatcaccgtcttgcagaattgacgatgaacaaactctacgacaagatcccctcttcagtatggaaattcattcgttaatcacgctacattactttttagagaacacgcaggtgttatctgcctcctcgttctggctaataacacaacgggctattatagaacagtgatatagatcacataccaatagcagggaacgttccctctaatactttattattgcttctattgcgataatatccaccaaggggagcgcgcgatgagtgacgaaaaacaaaaaatgatcgctggggcactgtattgcccgaccgatgaaactttatgccaggatcgactgcgggcgcgtcaactcatccatcaatacaattatactacgcctgatgaaataaataagcgtcaggcgattttacgcgacctgttgggtcgatgcgaagacgcctatattgaaccttccttccgttgcgactacggctataatatttttcttggtcactccttttacgctaacttcgactgcgtcatgcttgatgtttgcccaattcatattggcgataattgtatgctcgcgccaggggtacatatctataccgccacgcacccgctggacgccgtcgaacgcaacagcggcagagaattaggtaaacccgtcactatcggaaataacgtctggataggcggacgagccgtcgttaatcctggcgtaaccatcggcgataacgtcgtcgtcgcttcaggcgctgtggtgacaaaaaacgtaccgccagacgtcgtggtaggcggaaatccggcgcgaatcattaaaaaattgtagttcaaatgataactgttatgctaattcgtggttaatctgttacttttttcacgttacacctccctttaaaatgggctgttactaccccctatgtcgcagaaatcatgaaggcaaaagatgacagagatacagcgcctgcttagcgaaactattgatgacttaaacgtccgtgaaaaacgcgataacaggccgcgttttagtataagttttatccgcaagcatcctgggttatttatcgcgatgtatgcagcctggtttgcgacgctggcggtcatgctgcaatcagaaacgctggtggggtcagtgtggctgttagtggtgttatttatcgcatttaatggcttcttctttttcgacatcgccccgcgttatcactataacgacatcgatgtgctggacctccgggtctgttacaacggcgaatggtacaacacccgctttgttccccccacgctcattgagacgattcttcagtctccacaggtggataatgaacataaagtccagctgcaaaaaatggttgcccgtaagggcgaactttccttctacgatatttttacgctggcccgcgcagaagccagccggtaataaaaaagtgcgcaccctccctggtacgcactgctttccctgaactgttggttttttaacgtctttttttacgcccctgaaccgccttaaaacgcggatttgttttacaaatcacgtataagcgtcctttgcgtttgactatctggcaatccggatgccgttgttttgcattgcgaagtgagtttaacacctgcatttcatttacccccgtttagcgccgataaaatgaccaaaacgtttctggaagcgtgcggcgctactttcgctatcaaacgttttctgtctaccggtataaaaaggatgcgattttgatgacacatcaatagtgacatacggatatgtcacgccgtccagttcgatttcacgttcagttttgatagttgatcccactttcacatattcatttgcgctggtgtcgtgaaatacgacggttcggtatacaggatgaatatcaggtttcattgcgctctctcaattatgttataacataacaataaaatacgctatcaacgctcctttttcaaccggtaaacattcacgatctcttcctggcggcaaaagcaacgtggcgtaacgcgttagtctggcccctgtatctgtaaaatcgataaaatagctttatcattcgagggcgcgatttacgatcggatatactttctctacgctgtgtttataaggacatcactgtgacaacacgacatctggtcagcctggtaacgggagtgcttatcctgtctgtccttttcccgataggattgagcctgtggctggcgcaccgtcaagttgaaaaaaggtttaacgaagagctggatatcttctcgtcccgggtggcgctacgtacagaaagggtcagtgaccaggcaaaagccgcgttaacgcatattgcctcctttaaaggcgagccctgcagcagcgcccatttactcgccatgcgccgcgtgtcttatagctttcggtatgtccaggaagttctgtatcttaaaaattcgattcccgtttgctcctcacttgaaaaagagagccatattcccgctttccctccgcccatgaaaatcactcgcgacggttatcgcgcctggtttacggcgcaaaacgatctgggtataaaacgctatatggcggcactcgggagcgacagctatatcgtgatgatcgacccggcgtcctttatcgatgtgattccgtttggcgcatggccgattgacgtcgctattattggccgggaacgcaatactgtggttgccagcagcggtaaccttgaccacgctattcttccgctcattcaccatgagacgcccctgcggctggaaaaccgaggcattcagtatgctatccacccctttccggaaatgggcattactatcgtaagctgggcaccgaccgctccgctggaaaggagctggtatcgacaagcgtttatctggctaccggcgggcatcgtaacgggtctgctggctgcggcctttattctgcgtattttgcgtcggctacaatcgccccgccaccgtctccaggatgcgatagacaatcgcgaaattaacgtacactatcagcctattgtctccctgagcagcggaaaaattgtcggtgccgaagccttagctcgctggcaacaggcggacggcactttcctttcgccggaaatttttatcgcgctggctgaacaaaccgggctcacggagccgctaacccggctaatcatcgacaccgtttttgaagacatggggagttggttaaagtcccatcccgaacaacatatttcaatcaatcttgaggcatccgatctggcgtcggaaacgctcccgacgctgttaagcacgctgctgaaccgtagccaaatttctccgtcgcaaatcgcgcttgagttaacggagcgcgagttcgccgatccgaaaaccagcgcgcccattgtcgccagataccgtaacgcgggacattccatttatattgatgactttggcaccggctattccagcctcagctacttacaaaatctggatgtggatgtccttaaaattgataaatcttttgtcgatgcgctggaatataaaaacgtcacgccgcatattattgaaatggcgaaaacgctcaaacttaagatggtcgcagaaggcatcgaaacgaccaggcaagaacagtggctacgccagcatggcgtacattatggtcagggctggttatacagtaagcccctacccgctacggcatttattctttgggtggaacagcggctataacgtcgcacagcagaaaagaacagtgtggaaaggcagaattgggtgggggccctgccagctacatcccggcacacgcgtcatctgccttggctgcttccttccggacctgacctggtaaacagagtagcgttgcgggagaaccaacagagcccccattgagagcgttgtgaaccaacgcgcaggcgcattatcactgctatatcgtgcaattgcaacctatcaggcatcggatgctggtttcttgcgcatccgggctttcctccccccttattccagattatcctgaagcattaacgcaggattctattatggatattcaggacacatttcctcaacgcgtctggcaaatcgtcgcctcgatcccggaagggtttgtcacgacctacggtgatgtcgcccggcttgccggttcccctcgggcggcgcgtcaggtcggcggagttttaaaacgtctgccggaaggcagcactttaccatggcatcgggtggtgaaccgccacggcgcaatatcacttaccgggccggatctacagcggcaacgtcaggcattactggcggaaggcgtggtggtgtcgggaagcggacaaatcgatttacaacgctatcgctgggtgtattaaccctctccgtaacggagagggttggcgcaggattaatactgggtaggcgcaggaacggcagaagacggattgacctgggtcggcgaagtcgatggaaccgtcgtcgtcgcaccgccgctggcctgcacaggcaccgccgtttgctgtaccggtaccagcgtcagatccgctttagtgccgccattgttaatcaccggtttcacgctatcggtaataaataccagcttattgtcaacggtgatggccgcgctcagaagaatacgcgcgttaggttgaatatctgatgggttaaacggcaacacaaaactgaaaggcgcctgtttaccttcggtacgtaccgctttttgcgacagcaccttagacggcgcatcagccagcgaagcatctgaaagcgtcacggtcagcaccgcatctggcggcagagcgaccttctggcggatccagacggtaccggaaacattgggttgctgaatagtagactggttagctgtaatcgacatgttagggtttggcgcaggcgtctggatatcagcgcttttatcagcgcaggccgccagagatatcgcaaccgctaaaccacttacgatgtgcacgagtttcattcaattctccttatcatcaatgcaccagcaggcctttccccccgccggaagagtggttaacagaaatacaacgtgattaagtgtggcacatgtcactcatttttgcctggaattggtctgttattcagacttttgtacccatcggaccacttgcaaaattgcgttatactctgccctacctcgcttcggcatcgttgtcacctggagagtatgtatgagtcagacactgaataatttgctgacattattgaatctggaaaaaattgaagaaggactctttcggggccaaagtgaagacttagggctgcgccaggtatttggcggtcaggtggtgggccaggcgctctatgccgccaaagaaacggtgccggaagcgcgactggtgcattcattccacagttattttctgcggccaggcgacagccaaaaacccattatctatgacgtagaagtgctgcgcgatgggaatagcttcagcgcccgccgcgttgccgctattcagaacgggaaacccatcttttacatgaccgcctcattccaggcaccggaaccgggttttgaacatcaaaaaaccatgccgacggcagtcgggccggaaggactaccgtcagaaacggaaatcgcgcaatcgctggcgcatttactgccgccgattctgaaagaaaagtttctctgcgatcgcccgctggaaattcgtcccgtcgaatttcacaatccgttgaaaggtcacgtctccgcgcctgtgcgtcaggtatggattcgcgccaacggcaccgttccggatgacattcgcgtccatcaatatttactgggatacgcctcggatctgaatttccttcccgtcgcgcttcagcctcacggcatcggttttctggaaaagggcattcagatcgccactatcgatcactctatgtggttccatcgtccgttcaattttaatgaatggctactttatagcgtggagagcacttccgcctccagcgcccggggctttgttcgcggcgagttttatactcaggatggcgcgctggtcgcttcaaccgtgcaggaaggggtaatgcgtaatcacaattaaaaaacatgccgctatgcggcgttaatggcctgatgacgctgcgcttatccggcctacggtagactgggtaagcgcagcgccatcaggcatgttgcgcaatcacgcgttatacgcattctcgccgtgactgttcacatccagcccctcgcgctcctgctcttccggtacacgcagtccaacaaggatatccgccagtttgtaaccaacaaacgcgacaacgccggaccagacgaccgtaatagcaatactttccagctgtaccatcacctgatgtcccatcgtaacgccgtcgacaaagccgacgccacccagcgaactggcggcaaaaacgccggtcaggatacagccgactattccgcaaacgccgtgaacgccaaatacgtcgcacggatcatctacccgtagcagacgtttaagcatggtgactccccacaatcccgccagacccgcaataacgccgataaccagcgcgccgccaacgccaacatagccacaggctggcgtcacgccgaccagaccggcaatcgcgccggaacacgctcccagcagggaaggcttaccgcgtagcgtccactcgccgataatccaccccagaatcgcggcggcggtcgccaccacggtgttcacaaaggccagcgctgctatctcgtttgcgctacccgcagaacccgcgttaaatccaaaccagccgatatacagaatcgcagtaccggtaaagaccatcggcaggttatggggtttaaatgcttctttcccaaagccgacgcgtttgccaattaaataagcccccaccagcccggcgatagcggcgttaatatgcaccaccgtaccaccggcaaaatccagcgcgccgtgagcagccagcaggccgccgccccacaccatgtgcgcaatcgggatataagagagcgtgaaccacaccacgacaaaaatcagtaccgccgaaaaacgaatacgctccgccagcgcgccgacaatcagcccgacggtaatacaggcgaaagatccctgaaacgcgacatgaatatactgataaatcgtacccgttaccgccgtcaacgcgatattcttcaacatcgccccatcggcattaccgaagaaatgattcccttcgccaaaagccagcgaatagccgtacaccacccataaaatacagaccagcgcaaaggtgacggtcacttgcgttaacattgacagcacattcttggcgcgaattaatccgccgtaaaacagcgcgatacccggtatcgtcatgaacagcaccagcgcggtgcaaatcatcataaaagcactatccgctttatcggcaaccgctggcgcggctatcgttagcccaggcagcagcgccagtgaagccagtgtggtttttatcatcgctatcttcattttttcatttcctgttgctgtgtggcgggtcttacagcgctgcttcgtcagcttcgccggtacgaatccgaataacgcgcatgagctccgcgacgaaaattttgccgtcgccaatttttccggtgtaagccgctttactgatgatatcgatcacctcttccagttggtcgtcggcgatagccacatcaattttgaccttcggcaggaaattcacgctgtactccgcgccgcgatacagttcggcgtgtcctttctgacggccaaaccctttcacttcggtgacggtcagtccctgaatgccaatggaagaaagcgcctcccgcacgtcctccagcttgaacggtttgataatcacggtaaccagcttcatagaaccctccagtcagaattaggtaacggctgccgccgcgcatggactcttcaggatggatattgcaaaggatgtgccagaagctggcgagcgaggaaaagcgcggttagcggcgcgtctttatattgacgcgccccaaaaacgaagcagggaaagaaaaacgcaccacgacggtgcataatgggcgaggttttgccctgtggcgccaaaccttacgccgtagggccggattcttcgtgtacgctggcggctaactcctcgccaactaactgtaattgatacatttgccagtagcgcccttgcgccgccagcaattgttgatgcgtcccgcgctccaccgcctggccgcgatagagaaccagaatggtatccgcctccacgattgtcgatagccgatgggcaataaccaccaacgtggtgcgctcgcgaatcgccgccagcgcctgctgtatcgcctgctcagtgccggaatcgatgctggccgtcgcttcatcaagaattaatatttgcggggcgtcaaccagcacgcgcgccagcgccaatagctgtttttgcccgacggacagcgtatttccctgctcgccgagatgcgtatgcagcccgtcgctcaggccgcgcgccagatctgccagttgtaccgtttccagcgcctgccacacctgcgcctcggagacatcgcgccccagcgtcacattagccagaaaggtatccgccatcactaccgggtcctgttgaaccatcgccacgccctggcgtaaaacgcgatgattaagagaggcgatttctcgcccatccagccgaatttcgccttgtgtcagggggtaataccccattaataagctggcgagcgtgctcttcccgctgccggtgtgccccaccagcgccacaaagctacgggacggtactgatagcgtaatgtcctgtaaaacaagattatcgtcgcggtaagcaaacgacagatgatcaatatcaatcgccccgctttgtaacggcctgtcgtcgctgccatagcgctggcgcgggcgatccatcagttcaaaaacacgctctcccgccacaaccgcctgctgtagcatggattgctgggtggtcagttcaatgagcggctcgttcagacgtgacaaatagctaatgaacgcatacagcaccccgacctcaatcgtgccggcagacgtaaagctgaaaagcatcaacaaaccgcataaaatgagcgcggaaaagaggctaagcagcggacgcaataaaaagccgtccaagcgcagcgtctgcatccgcgccatgtagtgcgagcggctggcctcgcccatgcgttcgccgaagcgcgcctgctggcgaaactgctgaattacgctcatcccattgatgatttcgttaaagccgtcgttaatatccgccaggtatgcccgcacgcggcgtacaatcggcgtgctgtagcgctgataaatgaccatcacggtcaataccgccggaaaaatcaaaaccgccaccagcgccatccgccagtcaaggctgaacatggcgaccagcatggcgccgatcaacgccgcgctacgtaataccgttgcgacgaccgtgacgtacagatcgcggatgacttccgtatcgttggtcacgcgtgaaattaattgtccgacaggctgcgtgtcgaaggcgcttagcggctggcgcaaggcggcatccatgacgtccgtgcgcaaggactgaaccacgccaacggccgcccggttaaataataaagactgggcgtaatgcagacccgccgccagaaactgtagccccacataggcggccgccagccccgcgaccttgcccaacggtaaatggtggcgggccaccatgttatcaatgaaatagctgatcagcagcggaccgctaacctccgccgccaccgcaatccacagcatcatcaccgcgacagagagcggttttcgccatggcgagccatacgccagcaaccgtttcagcgtcggccatagctgtccaaaactacgcattcaccgcctcctcgccgcgttccggcgcgtcatccagagcggcctccagttgctgatagcgatacatatcgcgataccagccaatctgctgcgccagttgatcgtgatcgccgcgctgaacaacatgaccatgttgcataacgataatttcattggcgtcggtcagcgcggataaacgatgcgcgctgatgatgaccgtacgcccttcgccccactggcgcaaattatgcaaaatctgatgctccgtacgaccatctactgctgaaagcgcatcatcaagaagcagaatttccgcattcaacagtagcgctctggctatcgagatacgctgtttttgcccacccgataacatgacgccacgttcacctacctgcgtgtcatagccctgaggcaaacggagaatatcctcatgtacgctggctaaacgcgccacccgttcaatctcttcctgggtcgcctccgggcgtccgagcgcaatattattggcaatagaatccgagaacaaaaacggcgtctggctgacgaccgccagtcggctacgccagctatccagttgcagatgcgtcaacggcatgtcatggaatcggatctctccctgcgtcacatcaaaatggcgctggataagcgacaagattgtgcttttccccgcgccggtcggaccgcatatccccagcatctgacccggtttaagacgaaagttcacattctccagcgccggatgcgtcgtttgcggatagcaaaactcacgaatggccgccgtcagttcgccccgccccgccgggacgggctcttcgccatccttaactaccggcgcttccgccagcatggcgcggatgcggctgtaagcggcgctaccccgctccacgatattaaacatccaggccagcgccagcatcggccaaatcatcaaccccagatacatcataaagctggtgagttcgcccagcgtcaggctgccgttaaccaccatccagcttccgccgctaatcgcgagcaggttcgccatgccaatggcgatgtaaatggttggatcaaaacgcgcgtcaatacgcgccacgcgcatatttttcttgccggtatcttcggcatccgccgcaaacagcgaagactggcggtcctccagaccaaacgctttgatcatgcggatgctggtcagactctcctgcgtgcggtcgttcaggctggagaaggcggcctgcgccagtttgaaataatcatgcagtcgatcgccgtaacgtttgatcatcagcgccataatcggcatcggcaacagcgctaatagcgttagctgccagctaatttgcgtcgacatgacaatcagtaccgcgcagcccattaccagcgagtcaaccagcgtcagaacgccctcgcccgccgcaaatacgacgcgatccacatcattcgtcgcacgcgcaataagatcgcccgttcgatggcgctgataaaattcaggatgctgacgactcagctggcgataataatcttcacgcagttcgacggctaattgataagaagcgccaaatagcagcacgcgccagacatagcgcaacaaatagaccactacggcgatcagggcaatggtgccaatccacatcgctattcggcctggagtaaaatgctgtgcggttacgccatccacgacaatccccaccactttgggcgggatcagctgaagcatcgcaataagcataagcagggccaccgcgccaagatagcgacgccattcccggcgaaagtaccagcttaattgagcaaataatcgcacgcgttatttcctgatatgatttccggcaataccgggagaattattcaatgggcagagaggtggtgtacttaatctgttccatcgcaaaactggaggtgacgtctgacagtcctgggacgctattgaccagacgtttatagaagtcgtcataccgcttcatgtcggccacctgaactcgcatcagatagtcgtactcccccgccatccgccagaagccaagcacttccggcatctcagagacgacggtcacgaaccgacagtaccattcactgctgtggtgctgcgtttttatcaacacaaaagcggttaaccccagccccagtttttccgggtccagcagcgcaaccctgccaagcaggataccgtcatcttccaggcgtttaagccgcttccagcaaggcgttgtcgtcagattaacggcatccgccagcgcctgcaaagagagggtacagtcctgctgcaataagcaaagcagtttacggtcaattttatctaacatacccactccatagagaatatttttctccttacattgtaatttaaaggtcaaatagcaacaattttttccgtacttttcgctactcttggcacaaaatgataaatggatattaatgatgagtagcaattgggttaaaaatgccattaatgaaattaacgctgaccaccagcgctcagcggatacgcatcttattcgtttgcccctgtcggcatttccaggtatccagctttacctgaaagacgaaagcacgcatcccaccggtagcctcaagcatcgtctggcgcgctcgctgttcctttatgggttgtgcaatggctggattaaagaagacactccgattattgaagcgtcatcaggctcaacggcgatttccgaagcctggttcgcgcgtttactgggactgccgttcatcgccgccatgcccgcctgtaccgcaaaacgtaaaatcgaacagattcaattttacggcggccactgtcattttgtggagagcgcctgcgaaatttatgccgcctccgagcggctggcgcatgaactgaacggtcactatatggaccagtttacctacgcagaacgagctaccgactggcggggcaacaataatattgccgacagtattttccgccagatgcgcaacgaaccccatccggtaccgcgatttatcgtcatgagcgccggaacgggcggaacctctgcgacgattgggcgctatattcgctgccagggctatgatactcagctcatggtggtggatccggaaaattctgtctttttaccttactggcaggatcgcgacgcttcattacgcagcccggtaggcagtaaaattgaaggaattggtcgtccgcgagtagagccttcttttattccggatgtcgtggatgagatgctgcgcgtgccggacgccgccagcgttgccaccgcacactggctggaaacgcagctaggccgtaaagtcggcgcctctaccggcacgaatatgtggggagcgctgcagctagcggcccggatgcgcgaggctggagaaaccggcgctatcgtgacgttattgtgcgatagcggcgatcgctatctggatacctattaccatccggcctgggttagcgaccatatcggcgatttgacgccgtggtcagcggccatcgcaaaattacttaccggcgactagaaaccaaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcgtcgggatctccagaagcatgtgaatatgatctgcacaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtccctcattgggacccccttttgatttcttgttgaacttttgcagttgccagaccgcaagatgttttaacaaatcaaaaggggttttaataactggcttaaagctgaaagctttccggaacccccagcctagttgggggttttccatagacaaaaaaagccagactgaatgtttggcttgctggaagagatctctcattcgggggaataaggtagatgcggattgtccagccaatgcgtcaaaaagtgtgataccgcttgattaccacaatgtccgataaccgaaaggtgtggcagcgcggcgataagctgcggcatggcattgcccataatgagcccccgcccgacgctgcccagcatttcccgatcgttcatcgcgtcgccaaacgccatgcaatctgccagtgaaagccctaaatggttgctcaataccgccagcgccgatcctttattgcaccccagcggtagcacttccaggcagtcgacggcagagaaacagaggtgcgcgcgttcttccagcgcctcattgagctgaatgcgcaaacggatcagatcgtcatgatcgccgcaaaaacagatcttcgtcacctgatgggccggaatactttttatatcgataacctgataacgaaagccgctgtagacgtgcgcctggagtagcgcggggatctcctggcctgtaaaccagccgttgtcattaaacacatgcatactggctcgggtatcccaggcatggtgcatcaccgtatcggcaacctgaggatcgagatcctgacgatgcagcacgtcgccttccagcgagtgaattcgcgtcccgttaccggtaataagataagcatccagtgaaagcgtccccagaatatgccgcatctccagcacgtgacgacccgtagcgaatgtcagagtgatatcgcgttcgcgcagacgcgacagcgtggcgatcgtttctctacccaaatggtgatcgggcattaataacgtgccatccatatcaaatgctgccagacgggccatctctttctccacactgtaacgcggttaacttgttgttcagtattacctgagatatacggaagtaatagtgaacagataaaaggaagtgttccgggttttatgaggctactgaatcggcttaatcaatatcaacgcctctggcagccttccgccggggaaacgcaacatgtcaccgttagcgaactggccgaacgctgtttttgtagcgagcgccatctgcgaacgctgctgcgtcaggcccagcaggcgggttggctaagatgggaggcgcagtccgggcgcgggaaacgtggacggctccagtttctggtcacgccggaatcgctccgcaccgccatgatggaacaggcgctggaaaaagggcagcagctcaacgtactggaactggcgcagctggcgcctggcgagttacgggcgatgctccagccttttatgggcggccaatggcaaaacgatacgccaacattgcgtattccctactatcgtccgcttgatccgctgcagccgggtttcctgccaggacgcgcggaacagcatctcgcagggcaagttttttccgggttaacgcgcttcgatcgcgatagccaatatccttgcggggatttggcgcatcactggaaggtttccgccgacggtttacgctgggatttttatattcgctccacgctgcactggcataatggcgatgcggtggataccgcgcagttacacgaacgcctggaaaggctgcttaccctaccggcgctaagcaaattgtttattagcgtcgcacggatcgaagtaacgcatcctcagtgcctgacctttctccttcaccgacctgattactggctggcgcatcgtctggcgagctattgtagcggtctggcgcatcctgacctgccgcttatcggcaccggtccttttcgcctggcgttgttcacgccggaactggtgcgtctggaaagtcatgaccattatcacctcagccatccgctgctgaaagcgattgaattctggatcaccccgcaactgtttgcccaggatctgggcaccagttgccgccatccggtgcagattgccatcggcaaaccggaagagctggcgacgctgagtcaggtaagtagtggtatcagtcttggcttttgttatttaaccctcaaaaagggctcacggctcaacgtacagcaggcgcggcgtctgatacatattatccatcatacttcgctgctgaaaaccttaccggtagatgagaacttgattatgccaagtcaggggctgctacccggctggacaatcccgcaatggcaggacgttgatgaaacaccattgccgaaaaaacttaccctggcgtatcaccttcccgtagagctgcatacgatggcggaacagcttcgacattacctggcgacgctcggctgtgagttaacgttgatttttcataatgccaaaaactggaataactgccctgcgttggcgcaagcggatctgatgatgggcgacaggctgatcggcgaagcgccggaatatacgctggagcagtggctacgttgcgatcagatctggtcacatgtcctggacgcgcctgcgttttcccatctgcaggctacgcttgacgctctgcaaattcagcccaatgaaaaagatcgccgcgccgcgctacaacaagtttttgccaacctgatggatgacgccacacttacgccgctgtttaattatcactatcgcatcagcgccccaccgggcgttaacggcgttcgactcacccctcgcggctggtttgaatttagcgaagcctggcttccgccgccttcgccgtgaagaagctggtcgggattatccgtacgcgttaccatattggctttcgtcattgatcaggataactatgaaacgcgccgttgttgtatttagtggaggtcaggactccaccacttgtctggcgcaagcgcggcatcagtatgatgaagtgcattgtgtcacgtttgattatggtcagcgccaccgcgcagagattgatgttgcgcgcgcactggcgttaaaacttggcgcacgcgcgcataaagtgctggatgtcactttgctgaacgaactggcggtcagcagcctgacgcgggatagcattccggtgccggactatgaaccgaacgctgacggtatccccaacactttcgtaccgggacgcaatattctctttctgacgctggcggcgatttacgcttatcaggtcaaagccgaggcggtgatcaccggcgtttgcgagaccgatttttccggctatccagactgtcgcgatgagttcgtcaaagcgctgaatcacgcggtgaatctgggcatggcgaaagatatccgtttcgaaacgcccctaatgtggattgataaagctgaaacctgggcgctggccgattattggggccaactggatttagttcgcgaagagacgctgacctgctataacggcattaaaggcgatggctgtggtcattgcgcagcctgtaatctgcgcgctaacggcctgaatcattatctgtcgaataaagcggcggtgatggcggcaatgaagcaaaaaaccgggttaaggtgattgttttgccggatggcggcgcacgcaccttatccgtgcctggcgatatgcaccatggtcaatatcgccaggccggacaagttcaacgccatcagacagcgaggcgttattgcaccatctgttccagcttttcacgcaattcgccttccagcggcagcgctttttgcgtttttaaatcaatacaaacaaacgtgatgagcgcatcggccaccacctgcccttctggctccagcgtaatcgtctggcttaatacgccgcttttaccgttaagctgttgtacctggctggtcacggtcagtagatcgctcaataccgccgggcgacggtaatttatattgatgtttaccaccacaaaggcaatattgcgggccgtcatccactgaaagctgtcgctgttttccagcccatcccaacgggcctcttccagaaattccagatagcgggcattattaacatgttgataaacatcaagatgatatccacgaactttgatttgtgtttgcatagcgcaataaccttacgttgttgttataagtaagcgacaagtacagaggtcataactggtatgacctctacagtctggcaaattttggccactgtgcaagtgattacaatgttaaaactgccagattacgctccaccagcgcgcttcccattcccggcacctgctttaaatcatccaccgttttaaaaggaccatactcctcccgatagctcacaatagcctgcgcttttttcagcccaacgccgttcatcacccgcgccagatcctccgcagacgcggtattaatgctcaccctagtaccttcatcatcgctggctttagcaggtaatgccgctttggcggaggatgaagaaggcgtatccgcttttgtttccaccgctgcattttttgcgacaggcgtcgccgccagcgcgctatgggccatgcccgcgcaggttaaagaaagcgtaataagcagtgctttaattccgtgtttcatactgttttctccttgtttgttaacagtgcagccacgatagcggggcggagaaaaacgaacaaatggcaattctcagaaatggaaaaggccgcgaaagcggcctttgtgggatacaacgttttgcaattttttgcgaagcgcctcgacgattactgctgttccagagcgtcgccgattttgattttcgcctctttacgcagattgctcatcagcgcctcaaagacaatttgcgcattgttctgcgtgatgccctgcaccatcgcttttttctgcgcttccggcatggcgcccgctttcacctcgtcaaacgccagcagaacgacgttaccctgcatatcgttcgccacgccataaactggcttatctttcgtcggaaggcttaacgcaaaggccgcctgactcaccggatcctgactggtacgacttaacgttttaggctcgccaaaactcagacccgccgctttcatcgcttccgcgcctttgcccgctttcagctcgaccagcagtttttccgcatccagcttcgcctgttgttccgctttgttatgcttcaccagggcagtgacctgttctttcacttctgccaacggcttcacggcttcaggtttatgttcgctcacgcgcacaacaaaagcccggtcgccatctacggtgataatgtctgaattcggccccggcgtaccgttttcgcctaccagaccgccattaaagatagcatcggctaccggtttgaagttcagctcttccggtaaggtgtcacggctaaaccagccggtttcaacggcttttacgccagcgacctgttcagcgcctgctaacgactcattgtcgttgcttgccgcatcgctcaccttctgctgcaacgcatagtaagcatccagcgctttttcctgtttcactttcgcggcaatgtcgtcgcgaacctcgcttaacggtttcactttggcaggctgaatatcatccagacgcgccaccagaaaaccgacagacgacttaatcacgccagatatctggcctttttcttttaatccggcgtttttcagttccggcaccgtggcagactcttccagccagcccatatcgccgccattacgcgcagagatgatatcggtagatttctctttcgccagcgtggcgaaatcttcgcccttgttcagcgcatccagtaccgctttcgcatcatcttccgttttggtctgaataatgctgtaacgaatgcgctccggctgagtaaactgatctacatgctggtcataataggcctgaatatccgcatcgctgaccggtgcctgcatcgtcgcggcatccagcttgatatagcttacgcggaactgttccggcgtcataaagcggactttattctgatcgtagtagctggacacttcctgatcggtcacctgctgcttcgccgccagcgcgttgacatcaataacggcttcacgcaccacgcgctgttgagagactaatgccgccagttcgtcggtttcccctttcagcataaaatcagtaccggccacgccgttgatcagttgctgagtggtaagctggttacgcagcgcctgagtatactgatcggccgtcattcccatctgattcacaatcgcgttatagcggttgttgtcaaacttaccgtccacctgaaaagcgggagtggcgaaaatcgcctgctttacctgctcatcgctgatgcccagtttcagttcgcgggaatattgatccaacagcgcttcatctatcagacgattcagcacctgctggcgcaggcttttcatataaccttcgttggccgccagttcagaatacctgtcgcccaactgctgctgcatacggttacgttcgttgttaaacgcattctcaaactgtgcccggctgatttcctggccattcacttttgcggcgtagttattgcttccgccaatcaggtaaccactaacgccggtcaaaatgaacgacacgataatgataacgaaaataatcttgagcacgagactgtttgcagccgtgcgtaagctgtccatcatggtgtaaccacactccgctgtaggtgactttacactttatctttcaggcggcttctctgctggctactgagtgcttcgctcagtagccgcgtcgacgcaacctgaatgatttgcgtatatagacttcacgcgcatcgcattttctgaacgcggcgcacaaaagcctattgtgacaagaaacgagggcaattgtcagcccgcaacgcacagaaagtcccgaatcgccaataaaaaaggcacatcagttgatgcgcccttgtactttgtcacatcccccgaggggatcacgcttagtttaccgcgtctttcagcgctttacctgcacggaaactcggcactttggcagcggcgatggtgatctctttacctgtttgcgggttgcgaccagtacgggcagcacgctctttaacagcaaaagtaccaaagcctaccagtgcaacgtcatccccttctttcagagattcggtaacagaagcaataatcgcatctaacgcacgtccagccgcagccttagagatatcagcccctgcagcaattttttcgatcagttgagatttattcactcttctcttcctctttataatttatatcgcacctgaatccttcgaagtacgaccgcgcagcagttatatcaggcctgccacgcccttacaacacccgttaatggtggcagacccaatcaaccatctaaattagctatacaaaaaaaggctggcaagtccgaaatagcctgccagccctgtttttattagcgctatttgcgcgaggtcactattttgcggttacaacctgcattccagacggttcgttttgcagagcaagcgtcagaacttcctcaatgcgcttcacaggatgaatatccagatcggcaatcacgttgtccggaatttcctccagatcacgtttattttcgaatggaattaagaccgttttaatcccgccgcgatgcgccgccaacagtttttctttcaggccgccgatcggcaacacctgaccacgcagcgtgatctcaccggtcattgccacatctgcgcgcaccggattaccggtcaggcaggaaaccagcgcggtacacatcgcgataccggcgcttggaccgtctttcggcgttgcgccttccggcacgtgaacgtggatatcgcgtttttcgtaaaagtccggattaatacccagtttttccgcgcgcgcgcgcaccacggtcagcgccgcctgaatagattcctgcatcacttcaccgagcgagccggtgtaggtcagcttgcctttgcccggtacgcaggcggtttcgatggtcaacagatcgccgcccacttccgtccacgccagccccgtcacctgacccacgcggttttcgctatccgcgcggccataatcaaagcgctgcacaccgaggtagtcgtgcagattatcgccgttaatttcaatatgttttaacgacttatcgagcaacagttgtttaaccgctttacggcacagtttggagatttcacgctccagactacgaacgcccgcttcacgcgtgtaatagcggataataccgataatcgcgctatcgtcgaccgtcagttcgcctttcttcagcgcgttacgctcgatctgcttcggcagcaggtgacgtttagcaatattcagcttctcgtcttcggtataaccggacagacggatcacttccatacgatccagcagcggcgccggaatgttcatggagttggaggtggcgacgaacatcacatcgctgagatcgtaatccacttccaggtaatgatcgctgaacgccacgttctgctccgggtccagcacctcaagcagtgcggaagccggatcgccgcgcatgtccgaggacattttgtcgatctcatcgagcaggaatagtgggtttttaacccccactttggccattttttggatcagtttacccggcatagagccaatgtaagtccggcgatgaccgcggatttccgcttcatcacgcacgccgcccagcgccatacggacgtatttacgccctgtggctttagcgatggactggcccaacgaggttttacctacccccggcggccccaccagacacaggatcggccccttgattttatttacacggctttgtaccgcgagatactcaaggatgcggtctttcacacgctccagaccataatggtcagtatcgaggatttcctgcgcctgacgcaggtcttttttgaccttgctacgcgcattccacggcacctgcaccatccagtcgatgtagccgcgcaccacggtcgcttccgccgacatcggagacatcattttcagcttctgcagttccgcttccgctttctctttcgcctctttcggcattttcgccgcgtcgatcttacgcttcagcgcttcgttttcgtccggcgcgtcgtccatctcgccaagttctttctgaatcgctttcatttgctcgttcagatagtactcgcgctgggatttctccatctgctttttcacgcggttgcgaatgcgtttctcaacctgcagcagatcgatttcagattccatcatcgccatcagatattccagacgttcgttaacgtcggacatctccagtacggactgtttatccgccagtttcagcggcatatgcgcggcgatggtgtcagccagacgtgcagggtcgtcaatgctattgagtgacgtcagcacttccggcggaatttttttgttcagcttgatgtagccttcgaactggctgatagcggtacgcaccagcacttcttgttcacgctcatcaatggctggcgaatcaaggtactccgccttcgcggagaaatgttcgccgttgtcagacagcgcggaaatacgcgcgcgctgtaacccctcaaccagcacttttacggtgccgtcaggcagtttcagcatctgcaaaatagaggccacggtcccgacggtgaaaagatcgtttacacccggctcatccgttgatgcttccttctgggcgaccagcatgatttttttatcatggtccatagccgcttccagacaacggatagatttttcccgccctacaaataagggtatgaccatgtgcggataaaccaccacatcgcgcaagggcaatacggggatttcaatgcgttcagaacgctcaggattcatagagctctctcttagtttagtgtccgccaggtaatcagatagtatagctgtgctccataccacctataacatgtacgtcagtatatggggatgtttcccacacattcaacggcgtgtttacaggaaaaacgaaaggggagataaaatccccccttttttggctaactgattgtatgaatgtttaattattcgccagaagcctgcgcttccggtttgccgtaaatcagcaacggcttactctgaccggcaataacggactcgtcaatcaccactttttcgacgtcttccatagatggcaaatcgtacatggtatccagcagcgccgcttcgacgatagaacgcaggccacgggcaccagttttacgcgccatcgctttcctggcgatagcgttcagcgcttcgtcacggaattccagatcgacgccttccaggttaaacagcgcctgatactgcttggtcagcgcatttttcggctctttcaggatttgaaccagcgcttcttcgctgagttcgttcagcgtcgccaccactggcagacgaccgataaactcaggaatcagaccaaatttgatcaaatcttccggttcaacctgcgacaacagctcgccttcactggctttgtcggacttcgctttcaccgtcgcgccaaaaccaatgccggagccggtttcaacacggttagcgatcactttatccagaccggcaaacgcgccgccgcagataaacagaatcttagaggtatctacctgtaagaactcctgctgcggatgtttgcgaccgccctgcggtggaaccgcggcgacggtgccttcgatcagtttcagcaacgcctgctgtacgccttcgccggaaacatcgcgggtaatggacggattgtctgatttacgcgaaatcttatcgatttcatcaatgtagacaatcccacgctgcgctttttgcacgtcgtagtcgcatttctgcaacagtttctgaatgatattctcgacgtcttcccccacgtaacccgcttcggtcagcgtggtcgcatccgccatagtgaacggcacatccagcaagcgcgccagcgtttccgccagcagcgttttaccggaaccggtcggtccagtcagcagaatgttgcttttgcctaactcgacgccattgctggtatcgccgttacgcagacgcttgtagtggttatagaccgccaccgccagcacttttttcgcctgctcctggccgataacgtaatcgtccaggtgagtacgaatttcatgcggcgtcggcagcgcactacgttcacggtgcggagcaacttctttaatttcttcgcgaataatgtcgttacataaatcgacgcattcgtcgcagatatacacggatggaccggcaatcagcttgcgcacttcatgctggcttttgccgcaaaaagagcagtacaacaatttgcccgagccatctttgcgtttatctgtcatgagtcaaaacctcttctttgttctttgtgccgcacacgacgacgcaaatgccattctcaggcgcaagccgctaatcagcgttgtgccgcccttcattagtatatacacaaaatcattcgagctacatcaaggcggcaactcagcgactccgcaggcgcttacataagtaagtcactgggaggcgcgctggcaaccaacaccgaggtagcgtgaaggatgaagtgtatagcggcacacttgcgtccagggcatcaattacgatgggtcaaaattgagtcaaccaaaccgtactctaccgcttcaggcgcggagaggaagcgatcgcgctcagtatcacgttcaatctgctcaagagattgacccgtatgatgcgccataagttcattcatgcgcccttttactttcaaaatttcgcgggcgtgaatttcaatatccgtcgcctggccctgatagccgcccagcggctggtggatcatgacgcgagagttcggcaagcagaaacgtttgcctttcgccccggcagtcagcagaaacgcccccatagaggccgcctgtcccatacaaatggtgctgacgtctggcttaataaactgcatggtgtcatagatggacatccccgcagtaattacgccgccaggagaattaatgtacagatagatatctttttccgggttttccgcttccaggaacagcatctgcgccacgatcaggttagccatatggtcttcgacctggccggtcagaaatatgacgcgttccttaagtagacgagaatagatatcaaaagagcgctcaccgcgtgaggtctgttcaatgaccatcggcaccagcgccatatgaggggccaaattatctcgttctccgctgtatgacatttccgtctcctggataaaaattgaaaaaatctgctgtactgattgtaacctgatggacggattatcagccagtccctctgtaatgggtacggcatcgccataattcaagcataacaatcttttgctctaacgctaacactgaaacgcggttttcgcacccttaccacgcaaaatgcgtgacaaaaaaaacccgtcactgaaaggtgacgggtttttgtgcaaatttcgtgcttttaacgcgaaaaattacgcctgctggttcatcagctcattgaaggaagtggctttttcagacactttcgcttttgccagaaccgcttcaacagcctgttcttccagagcgacgttacgcatattgtccatcagctctttatttttgctgtagaactcaatcacttctttcggatcttcgtaagcagaggccatctcttcgatcaggcctttaacgcgttcttcgtccgctttcagctcgttggtacgaatgacttcgccgagcagcagaccgacaactacacgacgcttagcctgttcttcgaacagttcgcgcggcagctccagagcctgtttctcgttaccaccaaaacgctgcgcagcttgacgacgcagaacgtcgatttcgctgtcgatcagcgcagacggtacgtcgatgtcgttagcttttaccagaccttcgatcgcctgagacttaacgcggttacgcaccgcgcctttcagctcgcgttccatgtttttacgtacttcagcgcgcagaccggctacggaaccatcttcaacgccgaaacgtttgatgaattcttcggtcagttccggcagttcgcgttcttcaactttcttcaggttgataacgaacttagccgctttacctttcaggttttcagcgtggtactcttccgggaaggtcacatcgatagtgaactcttcgccagctttgtggcctttaacgccgtcttcaaagcccggaatcatacgaccctggcccatcgccagaacgaaatcggtcgctttgccgccttcgaactcttcgccgtctacagagccggtgaaatcgatggtcacgcggtcttccgcatccgcagcgccgtctttttctttccaggtcgcctgctgcttacgcagggtgtccagcatcacatcaacgtcagcgtcggtgacttcaacaaccggcttttcaacttcgatggattcgaggccagtcagctcaacttccggatagacttcaaactcgacggagtaagtgaagtcttcacccactttgtattcgcccggaacatagttcggcgcgcctgccgggttaattttttctttgatgatcgcgtcaacgaagttgcggctcatcagatcgcccagcacgtcctggcgaacagaagcgccataacgctgagcgacgatattcatcggtactttgcctttacggaagccgtcaatacgtacttttttcgctacgttgaccagctcgctttttacagcggtctcgatgctgtcagcagcgattgtaatcgttacacggcggccaaggccctgagtggtttcaactgaaacttgcatcttgttacctcaaaaaatcacagtgctcggtcaactctactccgcaagcacgtgctatttgcttcgcggaaccgggatgttctcataatcaatcacattccctgtcgtcagaatcatcccgaagacgttcatatataagacggcgcattatagcggcatcacttttgtgagtcgagaacggtgattgtgcgatgctgcggcggttttcacaattctcggctaatttttgtctgaatactgtacgacacgctcaaaattcagacaaaataaaacggcccgcaggccgttttcacataattctgtagcaacatactggaaaagcggaggtagttgcaaatccgttttgctacgcgatgcttcccgcgccgcgacaaggaggcgacgcgaagatagtatcctgcaatccttcccactctttgagggtataagtatgcagtgccagcgcatgtacggttgtggaaagttccgccgttaacgtaccgtaaatcatccgatgacgattaagaaaacgttcgcctgtaaagcgatcgctcaccagcacgaccttaaaatggctttccgatcctgctggaacattgtgacgatagctttcatccacaacttcgagaaacacggggtcgaacgctgtccttaatttttcttctatttgctcacgtatcatcatgaaaatctcctccgacaacgctgtgatgtcacccatccctttaaatactagccgcttttaccgtttccattacagcatgacaacaaaaatttagctttcgtctgattatttcagccaaacgtatgaagtttactgccttaatcattcttttagcgctcaaaatccccgctcgcgccgttatcaataccaaatcggacattacgacgaatttacctgcgttgaccacttcccctcgccgttagcggtgttatgatggcgggaatttttacctatcacgttttaagcgtcattgagagcctgaatatgttaaaaaaacttctctttccgttagtcgctctgtttatgctggcaggatgcgccacaccgccgacgaccattgacgtcgcgccgaagatcaccttgccacagcaggacccgagcctgatgggcgtcaccgttagcattaccggcgcggaccaacgccaggatcaagcgttagcgaaagtcacgcgtaacaaccagttggtaacgttaaccgcctcccgcgatttacgcttcctgttacaagaagtcctggaaaaacagatgacggcgcggggctatatgatcgggcctaacggcgcggttaatctgcagattattgttaaccaactgtatgctgatgtttcccagggcagcgtgcgctacaacatcgcgaccaaagcggatatcgcgattattgcgaccgcggcaaatggcaacaagatgaccaaaaactatcgcgccaactactctattgaaggggcgttccaggcctctaaccagaatattgccgacgcggtgaacagcgttctgaccgataccattgctgatatgtctcaggacaccagcattcacgattttatcaagcaaaacgcccgttaatagcaacaacaagacccggcagaagccgggtctgtagatgcctatgtcaagtcaatatttacgtattttccagcaaccgcgttcagccattctgctgatattgggttttgcctccggtctcccgctggcgctcacttccggtacgctacaggcgtggatgaccgtcgagaatatcgatcttaaaacgattggcttcttctcgctggttggtcaggcctatgtgtttaagtttctctggtctccgctgatggaccgctacacgccgccttttttaggtcgacgtcgcggttggttactcgccacccaactgttgttactggcggcgattgcggcgatgggctttcttgaacccggcacgcagctacgctggatggcggcgctggcggtggtgattgctttttgctccgcctcgcaggatatcgtgttcgacgcctggaaaaccgatgtgttacccgcagaagaacgcggcgctggcgcggcaatcagcgtgcttggctaccggttggggatgctggtttccggcggactggcgctatggctggccgatcgctggctcggctggcagggcatgtactggctgatggcggcattgttgatcccctgcattatcgccaccttactggcgccggaaccgaccgatactatcccctccccgaaatcgctggaacaggccgtcgtcgcgccgctacgcgatttctttggccgtaacaacgcctggctgattttactgctcattgtgctttataaactgggtgacgccttcgccatgagcctgaccaccacctttttgattcgcggcgtcggctttgacgccggcgaagtcggtgtggtcaataaaacgttgggcctgctggcgacgatcgtcggcgcgttatacggcggcatattaatgcagcgtctttcgctgtttcgcgcgctgctgattttcggcattttgcaaggcgcgtccaacgccggttactggttgctctccattaccgataaaaacatgttcagcatgggcgcggcggtctttttcgaaaatctgtgcggcgggatgggtactgccgcctttgtcgccttattaatgacgctatgtaataagtcgttttccgcaacacagtttgccctactgtcggccctctccgcagtaggccgggtttatgttggtcctgtagcgggctggttcgttgaagcgcacggctggccgacattctacctcttctcggttgtcgccgccgttcccgggctgttactgttgctggtctgtcggcaaacgctggaatatagctggcagagcgagcgtttcattccccgcacgcaataccgtggcacctacaatttcgcgctttcaatcctgctcgcgggcgtcgctttgctggcggtgtgggtactcctgctgaccatgaacgcgttggattacactaacttttcattcctgcccgaattgcttgagactgcggtagcgattgccgtgtgcggcattgtctttggcgggttgctggactacctggcgctacgaaaaacacgcctgctgtaaaacattatttgccgttgtaataacgacccggaattataacggctaaataaccatcaattgataaaaaatatatttgtctttttgtgcgcaacagaattttggaaattattggtaatttctacgctacctattttctttacacgattcagccgactaaatttaaatttctaccgttgattgtccttttattgataataaattgttaagtaattgttttatttttacattggttataccaattatccctcaacatcccacttacagacctcatccgttataacgcaaagtttcaacagtgtcttaaagttatttcgacatacttggcaacatatgtgacacgcgcggcagaacttggtaacacagaaccaatcatgtttacagtaatgcaaccttaccgtaaaatgcccctacactttaaacgccaccaggtcccgtggaattgaggtcgttaaatgagactcaggaaatacaataaaagtttgggatggttgtcattaattgcaggcactgcattactcagtggctgtaattctgcgctgctggatcccaaaggacagattggactggagcaacgttcgctgatactgacggcatttggcctgatgttgatcgtcgttattcccgccatcttgatggctgttggttttgcctggaagtatcgtgcgagtaataaggatgcgaagtatagcccgaactggtcacactccaataaagtggaagccgtggtctggacggtgcctatcttaatcatcattttccttgccgtactgacctggaaaaccacgcacgcgcttgaaccaagcaagccgctggcgcatgacgaaaaaccgatcaccatcgaagtggtttccatggactggaaatggttcttcatctatccggagcagggtatcgccaccgtcaacgagatcgccttcccggcgaacacgccggtttatttcaaagtgacctccaactccgtgatgaactccttctttatcccgcgtctgggtagccagatttatgccatggccggtatgcaaacacgtttgcatctgatcgccaacgaacccggaacctacgatggcatctccgccagctatagcggcccgggcttctctggtatgaagtttaaagctatcgccaccaaagaccgcgcagaattcgaccaatgggtcgcaaaagcgaagcagtctccgaacaccatgaatgatatggcggcgttcgagaaagtggctatgccaagcgagtacaacaaggtggaatatttctccagcgtgaaaccagatttgttcaaggacgttattaacaaattcatgggccacggtaagagcatggacatgacccaacctgaaggtgagcacagctcgcatgaaggaatggaaggtatggacatgagccacgcggaatccgccaactccaagggttgaggaagataagatgttcggaaaattatcactggatgcagtaccgttccatgaacctatcgtcatggtaacgatcgctgcaattatcgtcgggggactggcgatactggcagcgattacttacttcggtaagtggacctacctatggaaagagtggttaacgtcggttgaccataaacgcctcggtatcatgtatatcatcgtcgcgattgtgatgctgttacgtggtttcgccgatgccatcatgatgcgtagccagcaggcgcttgcctccgcaggcgaagcgggttttctaccgccgcaccactacgatcagatctttaccgctcacggcgtaatcatgatcttcttcgtggcgatgcccttcgttatcggtctgatgaacctggtggttccgctgcagatcggcgcgcgcgacgttgctttccctttcctgaacaacctgagcttctggttcaccgttgtcggcgttattctggttaacctctcgctgggcgtgggtgaattcgcgcagacagggtggctggcttatccgccgctatcgggaatagagtacagtcccagcgtcggggtcgattactggatatgggcgttgcaactctcgggtattggtacgacgttaaccggtatcaacttcttcgtgacgatcctgaagatgcgtgcgccgggtatgacaatgttcaagatgccggtctttacctgggcctctttgtgcgccaacgtactgatcatcgcctctttcccgattctgacggttaccgtcgcgttgctgaccctggatcgctatctgggcacccatttctttaccaacgatatgggcggcaacatgatgatgtacatcaacctgatttgggcctggggccatccggaagtgtacattctgattctgccggtcttcggggtattctccgaaatcgcagcgaccttctcgcgtaaacgtctgttcggctatacctcgctggtttgggcgaccgtctgtattaccgtactgtcgtttatcgtttggctgcaccacttcttcacgatgggcgcgggcgcgaacgttaacgccttcttcggtatcaccaccatgattatcgccatcccgaccggggtgaagatcttcaactggttgttcaccatgtatcagggccgtatcgtcttccattccgcaatgatgtggaccatcggctttatcgtgaccttctcggtcggcggtatgaccggcgtgctgctggcggtaccgggcgcggacttcgtcctgcacaacagcctgttcctgattgcgcacttccataacgtgatcatcggcggcgtggtgtttggctgcttcgcaggtatgacttactggtggccgaaggcgtttggcttcaagctgaacgaaacctggggtaaacgcgccttctggttctggattatcggtttctttgtagcctttatgccgctgtacgtactgggcttcatgggcatgacccgtcgcctcagccagcaaattgatccgcagttccatacgatgctgatggttgccgccgccggcgccgcgctgattgcgctgggtatcctgtgccaactgattcagatcttcgtttctattcgcgaccgcgatcagaaccgcgatctgaccggcgacccatggggtggccgtacgctggagtggtcaacctcgtctccgccgccgttctataactttgccgttgtgccgcacgttcacgaacgtgacgccttctgggaaatgaaagaaaaaggcgaagcgtaccaacagcctggacagtatgaagagattcatatgccgaaaaatagcggtgccggtattgttatcgccgccttcgcgacggtatttggcttcgccatgatctggcatatctggtggctggcgatagtgggtttcgcaggcatgatcatcagctggattgtaaaaagctttgatgaagatgtggattactacgtgccggtcccggaagtcgaaaaactggaaaaccagcatttcgatgagattactaaggcagggctgaaaaatggcaactgatactttaacgcacgcgactgcccacgcgcacgaacacgggcaccatgacgcaggccagaacaaaatcttcggattttgggtctacctgatgagcgactgcattctgttctctattctgtttgctacctatgccgttctggtgaacggcaccgctggcggcccgacaggtaaggacattttcgaactgccgttcgttctggttgaaaccttcctgctgttatttagctccattacctacggcatggcggcgatcgccatgcacaagaacaacaagagccaggttatctcctggctggcgttgaccttcttgttcggtgccggatttatcgggatggaaatctatgaattccatcacctgattgttaacggtatgggcccggatcgcagcggcttcctgtctgcgttcttcgcgctggtcggcacgcacggtctgcacgtcacttccggtttgatctggatggcggtgctgatggtgcaagtcgcccgtcgcggtctgaccagcactaaccgtacccgcatcatgtgcctgagcctgttctggcacttcctggatgtgatttggatttgcgtattcactgttgtttatctgatgggggcgatgtaatgagtcattctaccgagagcggcggcgcatcccacggcagcgtaaaaacgtacatgaccggctttatcctgtcggtcatcctgacggttattccattctggatggtgatgaccggcgctgcctctccggccgttattctgggatctatcctggcaatggcagtggtgcagattttggtgcatctggtgtgtttcctgcacatgaacaccaaatctgatgaaggctggaacatgacggccttcatctttaccgtgctgatcatcgccatcctggttgtgggctccatctggattatgtggaacctcaactacaacatgatgatgcactaagagcggcgagtatgatgtttaagcaatacctgcaagtaacgaaaccaggcatcatctttggcaacctgatctcggtgatcgggggatttctgctggcctcaaagggcagcattgactatcccctgttcatctatacgctggtcggggtgtcactggttgtggcgtcgggttgtgtatttaacaactacatcgacagggatatcgacaggaagatggaaaggaccaagaatcgggtgctggtcaaaggcctgatttctcctggcgtctcgctggtatacgccaccctgctgggtattgctggctttatgctgctgtggtttggcgctaatcctttggcctgctggctgggggtgatgggcttcgtggtctacgttggcgtgtacagcttgtacatgaagcgtcactccgtctacggaacgctgattggttcgctctccggcgcagcgccgccggtgattggctactgcgccgtaacgggcgactttgacagcggcgcggcgattctgttggctattttcagcctctggcagatgccgcactcttacgccatcgccattttccgctttaaggactatcaggcggccaatatcccggttctgccggtgataaaaggaatctcagtcgctaaaaaccacatcacgctgtacatcattgcgtttgccgttgcaacgctaatgctaacgttgggcggttatgctggttacaaatacctggtggtcgccgcggcggtcagcgtttggtggctcggcatggcgctacgcggttacaaagtggaagatgataaggtctgggcgcgtaagctgttcggcttctctatcattgcgattaccgcactgagtatcatgatgtctgttgattttatggtgccgaattcgcagaatctgctgacttacgtctggtaaagactttagatggcgtatcgcttgatacgccatctttcttttcgcgtttaaataaaaattcccgccttaagaatgtccatctctttaccgttaacaatccccgtcacagcggttacgctatagctatcaacatcgcaaaattccggctgatagataggttgtaatgtcgattcacgtagcgtatcagacttatacccttgtaaattgcggttctgcatatttagcccaaaaggctcaaatgcgataacctgctgtgacatcgccccggccttatttttcagcgccagtgagacgcgtaaattctctatactgctgactctatccgttttgacgacaaactccagctcgcatgcatagccgctgccctgactcgcaccgaaaacacgatcacgattgaaggttaacttcggcaaattcttttcacgcattgccacagcctcagcacgggcctgtcggtctttttcgcaggtcacctgaaaatggggatcgtctgcaaaacttgttcgcccctgagcaaacaactccgctgccttccggcagtccgtgtcgacaaactgaccgttggtatacatccaggcaagatagtttaaagcgcgagacttgcccatcttcgccgcccgttcaaagaattcaaacgcccgagcgtaatcaagcggaacccgcgtcccggagtaatagatctcaccaagatttatgagcgcatcgacattaccctgcgcagccgccaactcgtaccactgcccccccttctgcagatcgcgcttaatccctcgttttccattcaagtagaagtaaccgagtatattctgcgcatcagcctggcccaattcagcagccttgcggaaccattgcaacgaacgcgcctctttatcgtcgacctcaacaaaaccagagtcatagagactaccaacgataaagttaagttcagggtctctctcctgcgcccacagctccgcaaggtgcaggatatccgcctttgaataacccaggcgcgtgatgcgcgcggccatcgcgctcccgccgccggcatactggcgtaatgtttcaataaaccgggaacgctgagtaatatcgctttccgcggcttgctttgccgtatctatttcgtcggctatcaggcgcgtcaccgtctgcgcatcagtatcgatatctgctttactggttttatccgcaagctcttttgccaaaacgtcatcctgcatcacccccaggccatgcagataaaaataacgagcgttgtagcagccatagggttattcaacatgacaagcctgctcataatacttgatagcctgtatcgtatctttcggcacggcaacgccgtactcataaataaaccccaactccgccagcgcttgagcattattatctttggctaacgcttttagctcatttagcgcctgaacatctttctgcgcaatacggctatataacgcgtcaatatcatcacctgcctggcataccgatgcgaaagaaaacccaagcagaagcaaaagattccatttccgctttatcatttttcattcccttattctttatctaaaaagtgcacactgtcagctttcagcaaatcgacattcttaccgttaatcgttgccgtagcggatttcagcgtaaaatggatatcgccgatcccgtgacaaaaatcttgcgtatacagtgggagatcgtatggggtaatgagaggatcaacatcatgattttgcatatctatccccagagtattcaaaccgaatggcggaatcatcaacgtttcctcagttgccattccatcagcatttttcagttcaagtgtaatatgcaaattcgccatgttacggattttatctgtgccaatctgaaaaattaatgcacattctttcggtttagccgttatcccgcgagagaaaacactctctttttttagggttactttgggtaaagcatccgcgttttttttcgactctgaatatccgctgcgcacttacttaaaaatattttttcctcaactttcttacctacatatcgagatgctttcttgtaatacgaccaggctttatcacaatcaggtgcagtacctaaaccgttataatacatccaactcaacggcatcgttgagcgcgaattagtaccatcattttcaacctgcgtaaataatgccagcgctttagcgtaatcagtgcgccctgttgcaccagaataatagattttacctaacgcaatctgtgcatcgctgtccccctgctcagacgcctgcccataccatttttgcgcttcctgaatgtctggcttaatcccccactcatcgccctctccccccgaataaataccccccaagagagattgggcctcaacgacgcctttttccgcggcggcgcgaaaccatttcaacgaggccggcctggctttataaggctcatccacataatggccagagaaatcattaagggtgagtaaccccagttgataatccatttgtggatcgccgtcctgcccccatagcgtagcaaggcggaacgttttttcctgattaaatccgatacgactaaaaaaagcgcatcgctctcgggtctattatttagagcatgaattagtatactaataaatgccgcccgctgcgatttatccatatcggccaatgctttcgccacgtaaatttcttgcgaaaacttgtcaatatattcttgctcaatcaataaattatccagattcatttttttagcatacttattggcctgagcgctatctttcgccactccgtcgccatgctgataagcatacttcacattatagcaaccgtagttaccgccaagctcacaggcctgcttataatactgcaacgcctgttcgcgattcatcggtacattaaggccgtattcatggataaaccccagttcatccagaaccgaagctcttttttccacaggcaaagcatcaaaatccttctgggtaagcgcagcgtattttacatcatctttactgttgttctctgatgcattcacctggttagcaaataaaacacctgctaaaatacataatgataagaatttaattttcacaactaattcactccttgaataatataataaataagactgatgactaaccttctgcctgataaacgcgcgccatcacgcagaaagtttgctatcagtctcggcgttgttgaataaatcaaattttcaggagatggacggttctgatcattgccatcgtttcagaatcgggtccctatggcaaagcaaaagtttaaagtcacccactggccagccacactcaggcagcgcggttcgctgacagtctgacttgacgagcctgctattgctatatgaagcaacagcgtacacagcctgaaggccgtggctaaccgctacactatactgagatggctcagatagccactacagctcaaggagatcggaatatgaatgagcacaaggctatgctgactctcccgatcgcccctatcgtgttaacaatttatctcttttttagctcaactgtttcaaaaacataatatttgctaattaaccctctatttacccggcacactccccgcactacactactcccagcttttatacagaggtggcaatgaacgattataaaatgacgccaggggagctgcgcgccacatggggtttagggaccgtcttttcgttgcgtatgctgggcatgtttatggttctaccagtactgaccacatacggtatggcgctacagggcgccagcgaagcattaatcggcattgcgatcggtatttacgggctggcgcaggctatctttcaaattccctttgggctgctgtccgaccgcattggccgtaaaccgctgattgtcggcggactggcggtatttgtcgcgggtagcgtcattgccgcgctctcccactctatctggggcattattctggggcgagcgctacaggggtccggcgctattgccgccgccgtcatggcgctcctgtctgatctgacccgagagcaaaaccgcaccaaagcgatggcgtttatcggcgtcagctttggtatcaccttcgcgattgcgatggtattagggccgattgttacccatagtctgggattgaacgcgttgttctggatgatcgccgccctcgccaccctgggcattcttctgacgatctgggtggttcccaacagtaccaaccatgtgctgaatcgcgaatccgggatggtcaaaggcagcttcagtaaagtgctggcggagccgaggctgctcaagctcaacttcggcatcatgtgtctgcatattttattgatgtccacctttgtcgccctgcccggccagcttgccgatgccggtttccctgccgccgaacactggaaggtgtatctggcaaccatggtgatcgcctttgccgccgtcgtgccttttatcatctatgctgaagtcaaacggcggatgaagcaggtattcctgttctgcgtggggctcattatcgtcgcagaaatcgtgttgtggggagcgggccagcatttctgggagctggtgattggcgtacaactctttttcctcgcctttaatctgatggaggcgctgctgccttcgcttattagcaaagagtcgcccgcggggtataaaggaacggcgatgggcgtctattctaccagtcagtttcttggcgtggcgcttggcggctcgctgggcggctggatagacggcacgtttgatgggcaaaccgttttccttgccggggccgtactggcgatggtatggctggcggtggcaagtaccatgaaagagccgccctatgtcagcagcctgcgtgtggaaattccagcggatatcgttgctgacgacaggctaaaacagcgactgttggcaatgaaaggcgtaagcgaagcgctgatcgtggcggaagagcattccgcttacgtcaaaatcgacagcaaagtgaccaatcgctttgaagttgaacagcttatcagcaaaggatgaatgcagcattgccggatggcggcgaggctctatccggcataacaacttaatcgcggaagtttttgaactggaacggctggcctaaatcgtcgccgcgaaccagcgccattaccgattgcagatcgtcacgtgatttgcccgtcacgcgaatctcttccccctgaatttgcgcctgcaccttcagtttgctgtctttaatcagcttgacgattttcttctgcacggcgctttcaatgccctgcttcagcttcgcttccacataccaggttttaccgctatgcacgaactcgtccggtacatccagcgaagcgccttcaataccgcgtttaagcagcttggcgcgcagaatatcgagcaactgattgacctggaaatcggactcgctcagcaccttgatggttttattggcatcgttcagttcaatagtcgcctctacgccacgaaagtcaaaacgagactcaacctcgcgaaccgcgttatccacgccgttacgcgcttcctgcagatcaacttcagaaacaatatcgaaagatggcatcttttcttctcccttcattttcgttgcgttgcataatacctgcaacgaggcttaacgagaagcttagctgatgacgctataattagcgccataacacctggcgctgttgcaggtgaggaggaacaatgaaaattactgtactgggatgcggagccttaggacaactttggctttcggcactgtgcaaacatggacatgacgtacagggctggctacgggtgccacaaccttattgcagcgtaaatctgatcgataccgatggttcctttttcaacgaatcactgacggcaaacgatccggattttttggcgaagagcgaactgttgttagtcacgctgaaagcgtggcaggtttccgacgcagtacgaaccctggcgtcaaccctaccggtgacgtcgcctatcctgctcattcataatggaatgggaaccatagaagaactgcaaagtatccaacagccgatgttgatggggactatcacccatgctgcgcgccgcgacggtaatatcattattcatgtcgctaacggtactacgcatattggcccggcgcgcgagcaagacggcgattacagttatctcgccgagatcctgcaaggggtactgcccgatgtcgcctggcataacaatatccgcgcagagatgtggcgcaaactggccgtcaactgtgttatcaacccgctcaccgcgctttggaactgcccgaacggcgagctgcgccatcatactgatgaaatcaacgcgatttgcgaagaggtcgccgccgtgattgaacgtgagggctaccacacatcggcagacgatttatgctattatgttgagcaagtgattgacagtacggcagaaaatatctcatccatgttgcaggacgtgcgcgccatgcgccataccgaaattgactacatcaccggttatttactcaagcgcgcccgcgtgcacggtctcgccgttccggaaaatagccgcctgtttgaaatggtaaagcgaaaggagagtgagtatgagcgctcaggcactggtatgcctcgcccctggtagtgaagagaccgaagcggtcaccactatcgatctgctggttcgcggcggaatccacgtcactaccgccagcgtcgccagcgatggcaacctgacgattgtctgctcgcgcggcgtgaagctgctggcggatgcgccgctggttgaagttgccgacggcgattatgacatcatcgtgttgcccggcggaattaaaggcgccgagtgctttcgcgacagcccgctgctggtcgaaaccgtaaaacagtttcaccgctccgggcgcattgtcgcagccatttgcgccgcagccgctacagtgctcgtgccgcacgatatcttccctatcggcaatatgaccggttttccggcgctgaaagataagatccccgccgaacagtggcaggataagcgtgtggtgtgggatgcgcgggtaaaattattaaccagccagggaccgggtaccgctatcgattttggcttgaaaatcatcgacctgttggttggtcgtgaaaaagcgcatgaagtggcttcgcaactggtgatggcggcggggatttataactactacgaataagaatgattgccggatggcggcgtaaacaccttatccggcctacaaaacggtacagtctgtaggccggataagcggcagcgccatccggcagttattttacgggcgttcgccctgcgccagacgcgcattaatatgcgcaatcacctcaggtaaatccgccagtgaatccaccacgtaatgcgccccggcggcgtacagcttgctggccgcgtgctcgcggcggaccgcaacgtcctctttcgacattgtctgataggcgtcccatgttgcgccgaattcgttacccgataccgccagccccaccgtccacatccccgcgttaagcccctcgctaatgcccggcgcggcatcatctaccttcacgcagtgcgcgaccgcatcaatgcccagcgcaatcacgttttgcagcgccatccacggccccgggcgaccacccgcgaccaggtcgtccgttgccacccaatgatccggacgataaccatgctcagcggcggcgggaaccaggcgctccatcaccgctcgtgggtaaccggagcaggagcctatcttgataccctcggctcgtagcgtcgcgatcgtgtcgataactccggcaataggagaagaaaaatcgacaactttagcaatctgtaacggcatgaaagcggcgtagatggcatcaatatctgctgcgctcatggcgcggccaaactttgcctgccagcgcgcgtcaacagtaggtaattttcccagcgcttcaatgtgttgccatttacccagccccattggcacgcgtgcttcggcgagggtgatctccacatcaaatgcctgacggaacgcctcgacgaaaatttgcgtcggcgcgaaggagccaaaatcgacggtggtgcccgcccagtcgagaataacagcgtgaatacggttcatcatggttccttatttcgtccagtacatggcggtacgaatggcggtcagcagggcagtgatatcggcggcatatacttcgccaatgttgccgatgcggaagcagtcgctttgcgacaccttgcctggatagataacaaagccctgctctttgaggcggcgataaaattcgctaaagcgatactgcgggtcttccggtgaataaaaggcggtgataatgggcgaatgaagctcgtcatccagcagcgtgttaaagcccagcgcccgcattccggccaccaggctgcgctgattttgctgatagcgttgatgacgtgccgccacgccaccttctttcgccagctctttcagcgcctgtgcaaacgccaggacggtatgtgtgggcgaagtaaaacgccatttgccgtggttatcctccatgcagcgccactgggcgtagagatctaacgacagcgagcgggaacgccctttgcacgcggccagtttttgctcgcgggcaatcacaaaggcaaaacccggcacgccctggatgcatttattagcggagctgatcagatagtcgatgtgtaatgctgcaatatccatggggatgccgccgaagctgctcatggcgtcaacgatgtaggttttgccatagcgatgcgccagagcgccaacctcatcaatggggttgagcatcccggtggtcgtttcgctatgcaccatggcgatatggctgatcgtcgggtcggcgttgaggatcgcgtcgatcgcctgcacgttcgggcgcgcaacttcgccgcagtcgtaagcgtgatgggcgatacccataaggccggccatctcgaccattcgtgcgccgtatgcaccgttgctgacgatcagcaccttatcctgcggccccaatgcgcttcccagtacggcttccacagcatagctgccgctgccttgcagcagtacggaggtgtagccttcggaggccgttgccagtgcggtcaactgctggcggatctgttctaccacgccgatattgtaatcatcatcccaggtacagctatcgaacaacatcgcttctttcacggtgcgagaggtggtgagtgggccaggggtcagcaacagatagttacgcgaagtcatatcatttacctttggtctataccagattgcatttatcatgacgatctttgccgcgatgggtcaaagagaaaatcgcgctgcaacaaaaaattcatctctgcttgtataatggcggcaggtaaaacggaagcgagtaagcatgaaatctatcccgggcgatatcccgcagtacctgttgatcaaggcgcagcttcaggcgcgtattcagagcggtgcgttgaaaagcggtgataaactgccgtctgaacgcgaactgtgcgcgatcttcaacaccacgcgcattactattcgcgaaagcctggcgcagctggagtccagtgggcttatctggcgcgccgatcgtcgcggttggttcgttacgccggaacgcctgtggctggatccgacccagaacaccaacttccataagctttgccgcgagcaggggcgggagccaaaaaccgcgctactgagcggcgtgttaaccaccgtgcctgtcgaggtcatggagcccctccagctccagccgtttgatcaaatctatctgctgacccgtctgcgttacgccgatggccgcgccgtgtgctactgcgaaaaccattgtttgcccgcccgcgtgcctgagctgctgcagtacgatctcaacggcagcctgaccgaggtatacgagtcgcactacaacctcgtctataccagcatgcatctgtcgttctaccccaccgccatgcctgcgcaggccgcacaggcgctgggagttatggaaggacgcccggcgctgttgctgcgccgtctgaactacgatcaacacgggcgagtgctggatctggatatcgaatactggcgtcacgacagcctgcgcattgaggtagatacccactagcgggtgcgccggatgttggctgcgggccttatccggcctgtcaatcgtatcgtctcacggctatcccgataagcgcagcatcatccggcgtggactgatttatttctctttcatcgttttgtcatataagccgtttagcgtaaaaagcaaacctggtataggccagaaaatgcaacgtacgctatgaggctattacgatgaaactttcccgacttgctctgctgtctgtcttcgctctcgccagcgccccgtcatgggcggaatcagtggtcacggtgtactccatcgacgggctgcacgatggcgataacagctggtaccaggtgcagtttgacgcgttcaccaaagcgaccggcattaccatacgctatgttgaaggcggtggtggcgtggtagtggaacgtctggcaaaagagcgtacgaatccacaggccgacgtgctggtaaccgcgccgccattcattcagcgcgccgccgccgaaaagctgctggcgaactttaacaccgacgccgcctcggctatccccgatgccaacaacctttattcgccgctggtaaagaattatctgagctttatctacaacagcaagctgctgaaaactgccccggcgagctggcaggatctgcttgacggtaaattcaaaaataaactccagtattccacgccaggtcaggccgctgacggcacggcggtaatgctgcaggctttccacagcttcggcagtaaagatgccagttttgcgtatctcggcaagctgcaggccaataacgtcgggccatctgcctctaccggcaagctaaccgcgctggttaataaaggtgaaatctacgtcgctaacggcgacctgcaaatgaacctcgcgcagatggaacgtaacccgaacgtgaaaatcttctggccggccaacgacaaaggcgagcgcagcgcgctggccatcccttatgtcattggcctggtccagggggcgccgcagagtgaaaatggtaaaaagctgattaacttcctgctgagtaaagaagcgcagactcgcgtcagcgaactctcctggggaatgccggtacgcagcgacgtgacgccgagcgacgaacattacaaggccgccactgccgcgttagaaggcgtgcagagctggcagccaaattgggatgacgtagccgtttcgctgtcggcagatattagccgttggcacaaagtgaccgaaagcgagtaagcctgatgctgatgaaaacgactgccgttcacgcccctgcatcgcaggggacatcggggatagtcctcgactcgctgcgtgttgcgtatcacggcaacgtggtgcttaaaccgctctctttgacgattgaacctggcgaagtgctggcgctgattggcccatcaggatctggaaaaacgacggtgctgcgtgcggtggcgggctttgtgcagcctgcaggcggtcgtatcctgattggcgatacggacgtcacccatctgccaccctataaacgcgggttggcgatggtggtgcagaactacgccttgttcccgcatctgaaagtggaagacaacgtcgcttttggtctgcgtgcgcagaagcagccaaaggcgctaattaatgagcgtgtcacgcaggcgctgaagacagttggcatgagtgattacgccacccgttatccgcatcaactttctggcggccagcagcaacgcgtggccatcgcccgcgcgattgccgtgcgcccgcgcgtgctgttgctggatgaaccactgtcagcgctggacgcacagattcgtcataatatggtggaagaaatcgcccgtcttcaccgtgagctgccggaactcactattctctacgtcacccacgatcaaacggaagcgctcaccctggccgataaaatcggcattatgaaggatggctcgctgattgctcacggcgaaacccgcgcgttatatcaccatccgcccaatcgttttgccgccgaattcttaggtcgcgccaatattctctccgccatcgcgctggggataacggaggttccggggctggtggacgtcagctgcggcggtgcggtgattcgcgcgttcagccagggcagccaccacggttacaacaaactgctgtgcattcgtcctcagcacctcagcctaacgccgcgttcggcctacagcaaccgcttcaacgccacactgcaatcggtgcactggcaaggcgatttaacccatctgttgtgtgacgttgctggcgaaacggtgcggatggtgttgacgcatgtcaatccgctgccgcgcgtgggcgacaagctggcgctgtggttcgaaccggatgatgcggtcctgattgaggtataaccatgtcactcattttacctctggaaaaaccggcgcttaacctacgcccgctgctgtggctgttgctcccgttgctggcgctggcgacgctgtttttctggcctctgtcgctcatcgttgaacaggcgctacgcggtgccaatggcgagatcgggctcgagaccttccgccaggtggtcgactcgaaacgctttgtcggcgcgttgctgaacacgttgcaaatcgcctttttcgccaccgccggttgcctgctgctgggcagcgtgatgtcgctgattctggtgtttattcctttccccggcagcgagttgattggtcgggtcgtcgatacttttattgcgctgccgaccttcctgattacgctggcgttcacctttatttatgggtcagcgggtctgctcaacggtgcgctgatgagcctgtttgcctttgagctaccgccggtggattttctctactcgatgcagggtgtcattctggcggagatcacggtgttcactccgctggtgatgcggccactgatggccgcgctgcggcaaattgataaaagccagctagaggcagccagcattctgggggcacacccgttacgggtgattgggcaggtgattttcccggcggcgctaccggcgctgatggctagtggcagcctgtgcctgctgttgaccactaacgagttcggcatcgtactgtttattggcgcgaaaggggttaacaccctgccgatgatggtttacagcaaagcgattctggagtccgactatacggtcgcctgcatgattgcgttgattaacattgtcttgtcgctggggctgttctccctctatcgcctggcggcatcgcgtaccggcgtaaggagccagccatgctaatttggtcacctaaaggacgcgcagcggcgggcgttgtggctagcgtactgtttatcgtgttctttttcctgccgctggcggtgattctgatgtccagccttagccagcggtggaacggtattctgccgagtggcttcacgctgaaccactttgttaacgctctgcacggtgcggcatgggatgccctacttgccagcctcacgattggcttttgcgccagcctgtttgcgctgctttgcggcgtttgggcggcgctggcgttgcgtcaatatggggtgaaaacgcagaaatggttaagtatggtgttctatctgccgagtgcgattccgtcagtgtccgtgggcctgggcattctggttgctttcagccaggggccattgcaaatgaacggcaccctatggattgtgctgacagcgcactttgtgctgatttccgcctttaccttcagtaacgtgtcgaccggactggcgcgcatttccgccgatattgaaaacgtcgcgtcgagtctgggggcatcgccctggtatcgtctgcgtcacgtgacgttgccgttattgatgccgtggatggtgtcagagctggcgctgagtttatcgctctccatgggggagttgggcgcgacggtgatgatttatccaccgggctggacgacgctgccggtagctatctttagcctgaccgaccgtggaaatatcgccgacggcgcggcgctgaccattgtgctggtggccattacgctgctgctgatgatgaagctggagcgcattgcaaaacggttggggtagaaataaaacggtaggccgggtaggacatagccgccacccggcaaaggaattacgggcgatacaccttcacattggcaaacccctgctcgcgcagatagagcgcctgcaggcgactcattacgccgcgttcgcaccatagcagccaggttttgctctgatcgaggtcgccaaatttagtgctcagcttgtagaaaggcagcgaaacgacgtcgacgccttccactttcagcggcttgtcatcctgctcatcgacagaacggatatccagaatcacatcgttggcgccaaaaccgctcacggtttcaacttccaccacctcctgctgggtctgctgggcgatttcacgaatatcgacgttgttcgcttcttctaccaccttatcgagaatactgaagtcgaaattttcttcttcggcttcaattttcgctttaatggctttcaccgtcggactttttgaaatcacgccacagtattccggcatcgtacgggcaaaatcttccgtaccaatctggcgcgccaggttgataatgtgctctttatcgtaagagatcagcgggcgcaggatcagcgtgtcagacacgttatcgatcaagcgcaagttggttagcgtctggctggacacctggcccagcgcttcgccggtcaccagcgcctgtacgccgtaacgttccgccactttcgacgccgcgcgtaccatcatacgtttgagcaccacgcccatctggccgtcgtcgactttctccagaatctcgccgaccactggttcaaagttaatcgccacaaaacgcacgcgatgggagctgccaaagcggttccacaggtaatgcgccacctggcgaacgccgatttcatgcgccgcgccgccgaggttaaagaagcagtagtgtacgcgacagccgcgacgcatcagcatatagctggagacgctggagtcaaaaccgccggagatcagcgacagcacgtcttcctgggtgccaatcgggaaaccgccaataccttcataacgccctttgatcagcagcaggcgatcatcttccacttccagatgcaccgtcacatccgggttagtgagcttcacgcgcgctgattcaatatgctgatttaatccgccgccaacatagcgctccacttcaatggagctaaactcatgcttaccgcgacgttttacccgcacgcagaaggttttgccttcaagctgttcgcgatactgcgccaacgctttctcgaaaatgtcgtgcatatcggtgaacggcacatcttcgacttcaagaatatggtgaatccccgggatgcgggtcagcgcgtcgcgaatcgccagacgctggttttcatctttggcgcgaacttcaatgttatcccagtgacggacaaccgcgagggtctcatcgtagtgctttaaaacgttacggatgttcccggttaaaatttttataaagcgcaaacgcacagattggcttttgatagtgatttccgggaacaatttaatgataaacttcatggcggtaatggttctttagcaagctatctaaggcttgtcgtggagaaatagtacagcagcccatacctacggctgcatccaggcgcggaagtatatcaccatcacggacatcttgcgcatttccccttaccattgcgcgttatttgcttatcagtgcgagtccgttaccatagacttgtgctgccattacagagagtcaaacagtcatcatgccgaagaaaaatgaggcgcccgccagctttgaaactgcgctgagcgagctggaacatattgttacccgcctggaaagcggcgatttgccgctggaagacgcgctgaatgaattcgagcgcggcgtacaactggcgcgtcaggggcaggcaaaactgcagcaggcggaacagcgcgtgcaaattttgctgtctgataatgaagaggcttcacctgagccttttatcgcggataatgagtaaatggactttacgcagcagctacaggcttgcgtaacgcaagcgaatcaggcgctgagccgttttatcgcgccactgccctttcagaacactcccgtggtcgaagccatgcagtatggcgcattattaggcggtaaacgcctgcggccatttctggtttacgccaccggtcaaatgtttggcgtcagtacggcaacgctggatgcgccagctgcggcggtcgaatgcattcatgcctattcgctgatccatgacgacctgccagcaatggacgatgacgatttgcgtcgcggcctgccgacttgccatattaaatttggcgaagccaacgcaatcctggcgggagacgcgttgcaaacgctggcgtttaccattatcagcgacgcgccgatgccggaagtcgccgatcgcgatcgtatcgcgatgatcgccgaactggcaaacgccagcggtatcgccggtatgtgcggcggtcaggcattggatctggcggcagaaggccagcggatcactctggacgcgctggaacgcattcatcgccataagaccggcgcgctcattcgcgccgccgttagacttggcgcgttgagcgcgggcgataaaggacggaatactctgccgatacttgaccgctatgcagagagtatcggccttgccttccaggttcaggatgacattctggatgtggtgggcgatactgcaacgttaggtaaacgtcagggcgcagaccagcagcttggcaaaagtacctaccctgcacttctgggtcttgagcaagcccggaataaagcccgggacctgatagaggacgcccgtcagtcgttacatcagctggccgcgcaatcactggacacctcggcactggaagcgctagcgaactacataatccagcgtgataaataaaccccatatccaatgagcttgcgatgagttttgatatagccaaataccctaccctggcattggtcgactccacccaggagttacgactgttaccgaaagagagtctgccgaaactctgcgacgagctacgccgctacttactcgacagcgtaagccgttccagcgggcatttcgcttccgggctgggcacggtagaacttaccgtggcgctgcattatgtctacaacaccccgtttgaccagctaatctgggatgttggacaccaggcttatccacataaaatccttaccggtcgtcgcgacaaaatcggcaccattcgccagaaaggcggtctgcacccgttcccgtggcgcggagaaagcgaatacgatgtgctgagcgttgggcattcctccacctccatcagcgccggtatcggtattgccgtggcggcggagaaagaaggcaaagatcgccgcaccgtctgtgtgattggcgacggcgccatcaccgccggtatggcgtttgaagcaatgaatcacgcaggcgatatccgacccgacatgctggtcattctgaacgacaatgaaatgtcgatttcggaaaacgtcggcgcgctcaacaaccatctggcgcggctactttccggtaagctttactcttctctgcgcgaaggcggaaaaaaagtcttctccggcgtaccgccaattaaagaactgctcaagcgtaccgaagaacatattaaaggcatggttgtgccgggaacactgttcgaagagctgggctttaactacatcgggccggtcgatggtcacgatgtcatggggcttatcagcacattgaagaacatgcgtgacctgaaagggccgcagttcctgcatatcatgaccaaaaaaggccgcggctatgagcccgcggaaaaagatccgatcactttccatgcggtgcctaaatttgatccctccagcggatgtttgccgaaaagcagcggcggtctgccaggttattcaaaaatcttcggtgactggctgtgtgaaaccgccgccaaagacagcaagctgatggcgatcaccccggcaatgcgcgaaggttccggcatggtggaattttcacgtaaattcccggatcgctattttgacgtcgctatcgccgagcagcatgccgtcaccttcgccgcaggtctggcgattggcggctataagcccgtcgtggcgatctactctactttcctgcaacgcgcctacgatcaggtcatccatgacgtcgctatccagaaactgccggtcatgttcgccatcgatcgcgccggtatcgttggcgcggatgggcaaacacaccaaggcgcgttcgatctctcctatctgcgctgcatcccggatatggtgatcatgacgccaagcgacgagaacgaatgtcgccagatgttatttaccgggtatcactataacgacggcccgacggcagtacgttatccacgcggtaatgcgcagggcgtggcgctaaccccgctggaaaaactgcctattggtaaaggtcttgtgaagcgtcatggcgaaaaactggcgattctgaactttggcaccttaatgcctgaggcggcgaaagtcgccgaagcgctgaatgccacgctggtcgacatgcgctttgttaaaccgctggacgacacgttaattctggagatggccgcgcagcatgacgcgctggtgacgctggaagaaaacgccattatgggcggcgctggcagcggcgtaaacgaagtgctaatggcccatcgtaaacctgtacctgtgctgaatatcggtcttccggatttctttatcccgcaaggaacgcaggaagaagcccgcgcggaactggggcttgacgccgcaggcattgaagccaaaatcaaggcctggctggcataatctcctctttgctcctgctatgcttgaagagtgacgggtataacaggagcggagtcatgcaatacaacacgttaggaaataccgatcttcgggtgtcccgcctttgtctgggctgtatgacattcggcgagccgagtcgcggcaatcacgcctggacgcttcccgaagagagcagccgtcccatcatcaagcgcgcccttgagggcggcattaacttttttgataccgccaacagctactccgacggcagcagcgaagagattgtcggtcgcgcgctgcgtgattttgcccggcgcgacgaggtggtggtagcgacgaaagtcttccatcgcgtcggcgatctgccggaaggattgtcccgcgcgcaaatcctgcgctctattgacgatagcctcacccgtctgggaatggagtatgtcgatatcctgcaaatccaccgctgggattacaccacgccgatagaagaaactctggaagcgctaaacgacgtggtaaaggcgggtaaagcccgctatatcggcgcttcctcaatgcacgcctcacaatttgcccaggcgctggcgctacaaaaacaacacggctgggcgccgtttgtcactatgcaggatcactataacctgatctaccgcgaggaagagcgtgagatgctaccgctgtgctggcaggaaggggtcgccgtgattccgtggagtccgctggcgcgcgggcgcttaactcgcccctggggagaaaccacggcccggctggcctcggatgacgtgggcaaaaatttatacgatgaaagcgataaaaatgatgcgcaaatagcggaacggctggctggcgtcagcgaggcgcttggcgcaacgcgagcgcaggttgcgctggcctggctgctcagcaaacgaggcgtcgccgcgccgattatcggcgcttcgcgtgaagagcagttagatgagttgctgaatgccgttgatttaacgctcaaaccggagcagattgccgaactcgaaacaccgtacaagcagcatccggtggtgggatttaaataatctgccattgcccgatggcgcggcgcttatcgggcctgcgaaatcgacatattgttcggaggcaggccggataaggcgtttatgccgccatccggcaaaccctttaaataataccgagcggccagtgatgaccgataaaatacagtatgccagcggatatcaccccggcgacgatatcatcgatcattatccccatgccgccgtgcacgttgcgatcaaaccaacggatcggccagggtttccacatatctagaatgcggaaaataacgaacccggcagccacccattgccagtccgtcgtcggcaacgccattagcgttatccacataccgataaattcatcccagacaatactgccgtggtcgtgtacgcccatatctttcgccgtctgatggcaaagataaacgccaatgcagattccaaacatcacgaccagcgaataaagctgccacggcagaaacgtcatcagataccagaaggggatcgccgccagagagcccatcgtacccggcaccacggggctcagcccgctgccaaagccggtagcgagcagatgccacggattgcgcaaattcaggcgacttttcgcaacatctttatggcgtggcaaaatggtcatatcctttccagtcgaaggtgacaggcattccgtcacgtacaaaattcagcccttcaatatctgcgctcatttggcctatgcaggtaaagggaacacccagttgaccaatggcgacatccagcgcgccacggttcagttccggcaccgtaaagcacaactcatagtcttcgccgccggaaagcgcccaacgcagctcctgcccgtcatcaacatggcgcatcatcgcatcggattttggcaacgcatcaacatccactcttgccccacagccgctggccttgacgatatgccccagatcggaaatcagaccatcggaaagatcgatagccgcgctggcgatgtcacgcagcgcctggccgtgtaaaatacgcggcgtcgggcgtaaatgccgttgaattaaatagtgagcatcggtctcctccgacacctgtagccggttttgcaaaaccgccagcccggcagcgctgtcgcccggcgtaccggtgacataaatccagtcgcccggcttcgcgccagatcgcttgagcgcgcgccctgccgggatataaccgtggatacccagcgtcatcgacagcggtccacgcgtggtgtcgccgccaatgagctgcatatcgtagtaattcaatagcgcaaacaggctgtcgctaaaagcctccagccacggctcatccacttccggtagcgttaacgccagcgttaaccaggccgggtcggcccccatcgcggccagatcgcttaaattcaccgccaacgctttataagccagatcggcaggatcgatatcagggaggaagtggttgcccgccaccagcgtatcggtactgatcgccagggtctgcttttcaggaatattcaggagcgcgcaatcgtcgccaataccggtttcaacatcaagacgagagcttcttacacggtcaaaataacgggcaatcagggaaaactcgccacatgccatacgttatgcctcagcagaaaaaaagaaaaggccggagacggcgggtatcgatcgcccgctatctttccggcctgtgaatcactttttgttgggacgaatcaccggagctgctttatccagtacgccgttgacgaatttgtggctgtcttcagcgccaaaggttttcgccagttcaatcgcttcgttgatggccactttataaggcacatcgctgcgttttgacagctcaaacaacgcaatacgcagcacggctttttcaacctgtcccagctcttcaagcaggcgggacagatacggtttcattaaaccatccaggtacgcgctgttagtcgccaccccggatagcagttcacggaaatagagaacgtcgacgtcttttacgtcctgttccgccaggaactggtattcaacatcagcgatgtcgttctgggacaactgccaggagtaaagcgcctggacggcacactcacgggcgcggtgacgagcagcaggtttcacggaattccccttacaaaaaatcaggccttaatggctttcaatacattaatcatttcaagcgcggtcagcgcagcttctgcgcctttattaccggcttttgtaccagcacgttcgatggcttgttcaatactctcggtggtcagaacaccaaaggctaccggcacgccgctgtcctgggcaacgcttgccaggccattgctggcgccgcctgccacatattcaaagtgcgcagtccccccgcgaatcacggttcccagcgcaaccacggcgtcgtatttaccgcttttcgccagcgcttcggtcgccagcggcagttcataagcgccaggcacccacactacggtaatattatcatcttttacctgaccaatacgcgtcagggcatcaaccgcgccatccagcaggctgtcgttgataaactgattgaaacgcgcaatagtgatggcgacacgagcgtcaggggctgcaacgttagctttaataatgttcatattctctcttccagggttcatttggccccgcaggggggcggattttatcataataatttgagcgctgctcccctttcgacgggagaactcatgcgctcaccatatgcaggcaaacatccgggccgacatgacgtatttcgctgaaggtaaattgcggcgcgtcggcgagcttctcaagccccggcaattcgcataatccccgcgcctgggttcccaacaatttaggcgcgacatagacaatcagttcatccaccagcccggcttgcagcaacgcgcccgccagtcccggtccggcctcaacccatatgctattaatctgctgcctgcctaactgcatcatcagcacaaccagatccaaatgtccgttgtgcgccggcacgctgatagtacgaaccgaatcgggccacgcgtggctatcttcctgggtacgcgcaatccacgtttcgccaggctgctgcacaatacgatgcgcaggcgttacccggttttggctgtcgataacaattcgcaccggctggcgcagattttcctgcgggtaagacgcctgtgtagaggcgtctaactccgcccaacgcaccgtcaaggccggatcgtcagccaataccgtcgcgctactggttaaaatagcgtggctttgcgcacgcaagcgctgaacgtcgcgccgggcctgcggcgaggtgatccactggctttcgccgctggccatcgccgtccgtccatccacggaggcacccagtttaagctgaagataagggaatccggtacgcatccgtttgaggaagcctttattgagcgcctccgcttcactcatcattaacccgtggctgaccgcaatacccgcctgttgcaggcgatacagcccgcgcccggcgacctgtgggttcgggtcctgcatcgcggcgaccacgcgcgcgacgccagccgcaatcagcgcatcgcaacatggcggcgttcgcccatgatggctacagggttcaagcgtgacataggcggttgcgcctttggcttttgcgcccgccatccgcagcgcatggacctcggcgtgcggctctccggcgcgatggtgataaccttcgccgacgatgtcgccattgttaacaatgacacagccgacattagggttcgggtgagtggtgaaacgtccacgctgcgccagtttgagcgctcgcgccatgtaaaactcatcctgcatggcttagtcctgtaggcgagcgatttcttcgccaaagtctttgatatcttcgaaactgcgatagacggaggcaaagcgaatatacgcgactttatcgagttttttcagctgctccatgaccaggttgccaatcatcttgctgggaacttcacgctccccagtggcacgtaattgtgacttaatatggttcaatgccatttcaacatcatctgcgctgacgggtcttttttccagcgctctcaacatgccgctacgcagcttatcctcattaaagggttcgcgcacatcgttgctttttatcacgcgcggcatgaccagttcagccacttcaaaggtcgtaaagcgttcattacacaccagacactgccgacggcggcgcacggacgagccctcgcctacaagacgagagtcaatgactttggtatctacggcgaaacaaaatgggcaatgcatacggcgtcctgaccagatgatttaggaaatgctattttaccctgaactggcgcgacaacaaaggcggagcgcttttgagataaaggatcggtgcctttgtgcgtatagcgcactaccattacgctatcggaccacgaaggaaatgatcgacatgacaagacgttacctaagaattctcctggtgggaagtctcttgagcctgaccgcctgcgcgccgcagagcgaagttcgccagatgcatcaaagcattagcaccctgaataaagagatgacccaactgaatcaggaaacggtaaaaattacccaacaaaataagctgaatgcggattcaacccgcggcgtctatttgttgcctggcgccaatacgcctgcccggctggagagtcagatcggtacgctacgtatgacattgctggaaattacgcctgtcgctgacggcgctcacgcaacgttacgcattcagggcaagtcccgcgatccgctaccggcattcagcgctaccgtagagtacgggcaaattcagggcactacggagaactatcaggaggtgaatgcgcagagccttctggtaaatgcgcccgccagcttgctggcgcccagtgatgtcaatattccgttaccgttgaaggggatcacaccggcgcagttaggcttcattcgcatccatgatattcagcctgttaatcaataaacgttctggcggagcgttttgtgcgctccgcaacatcctctgcgcaacttttgttgcccttctgacatttccgtaatttatgacacggattgttaatattcatgaaagatagtactgtcgccgcgcctaaagtgcgcaaacgtgaacgcaatcgattacgtaaatgatagatatgtgaaacaagacatatttttgtgagcaatgatttttataataggctccgcagaaacacgaaatatttagaaacgcaaattgcgttcttttcactcccgcaagggatttcaaacagtggcatacatatgaaaaaaactttactcgcagtcagcgcagcgctggcgctcacctcatcttttactgctaacgcagcagaaaatgatcagccgcagtatttgtccgactggtggcaccagagcgtaaacgtggtaggcagctaccatacccgtttctcgccgaaattgaacaacgacgtctatctggaatatgaagcatttgccaaaaaagactggtttgatttctacggctatatcgatattcccaaaacctttgattggggtaacggcaacgataaaggtatctggtccgacggttctccgctgttcatggaaatcgaaccgcgtttctcgattgataagctgaccggcgcagacctgagctttggcccgtttaaagagtggtatttcgccaacaactacatctacgatatgggcgataacaaagccagccgccagagcacatggtatatgggtctggggaccgatatcgacaccggcctgccgatgggtctgtcgctgaacgtgtatgcgaaatatcagtggcaaaactacggcgcgtccaatgaaaacgaatgggacggctaccgtttcaaagtgaaatacttcgtccccatcaccgatctgtggggcggtaaactgagctatatcggctttaccaactttgactggggatctgatttaggcgacgatccgaaccgtaccagcaactccatcgcttccagccatatcctggcgctgaactacgatcactggcactactcggtcgttgcgcgttacttccataacggcggacagtggcagaatggcgccaaactgaactggggcgacggcgatttcagcgcgaaatctaccggctggggcggttacctggtcgtgggttacaacttctaaacctgcaaaaaagccagaggtcgtcctctggcccgtttcgggcgcatgctgccatgcggcggcgagtcgcgcccacttcacattacttccggcgatgccaccagcctaaaaacagacctgtcgcaatcccgaccagcgttggtgccgccagatcgtgccagatagtaatgctcaactctgtgagcgtcatattgccgcctttgttgcaatggcaacggttcgcggctatcctcaacttgtctggggtcaagttagcccccgtaatgttgccggtgaataccgaacaatgtgcgggggttttctctttccagcgacaaggccaccggggatcaagcccccgcaacattgcgcctcaccgggttgccccggcttaccgctgattctactctgctcgccagtatcggcaggacttaaaaacaaaaaaatcccaaccttgcgatcggaattccagtgacaatgtatgcgttacaggacgtttggggctggcgacaaactccggggctgaaaaaatgtcagattgcatccgacctacgaaaaccaataattcatttatattgcggattccgttgggtggagtggagcgaagcgtaacctaacattcaacagcaccaacagctttgtcagcagtctgcttatttctttttgttcatcatcgctttcagatcggcaaacgggttataagtcgcctcgccgacatctttttgcgcatcttccccggcaatgaccgtcgaaccgtactgatcggcttcggtatatttagaatgctcatgatcgtggcagtagaggcacaatagctcccagttactgccgtcttccgggttattggtgtggtcatgatcgatatgatgcaccgtcagctcacgcagatttgaatacacaaactcacgggaacaacgtccgcacacccacggaaacagcttcagcgctttttcacgatagccgctttccaggcgcgcgtagttttttgggatgatagccataattaacaggtacctgaataatacaaagggttatgcgcagtttcccgcgaagccgggcttttagcaatgattctgtgcaacttatatatccaggtaaggaaggctatttcaggcaaactgatgaccaatcaacccgttttacaagcgttggaggtatcgctatcacatcttacggcattttttcgtgctcgactttacgcaaaaaatcacgcaaagaacggtcgattgtttcacgaaatcgccggttaagcggagtaatttgtaaacagcgatcgaggcgaaaacaccgatagtcttcccgtctctcacaccaggcaaccagtagccagtgctctccccagaaaaacaatcccagaggttgtatatcccgcgaagagagatgccccgcttcatcacgataatgtagcgccaacacctgctgcgccgaaacagcctgatggataagatcaaacgcgctgcgcgaatgtggagatgtacccaaatccggagcgtaaatccgtgtctgctccgctttacgacggctctcttccggtaaaatagccaacactttttcctgggcggattcaagctcgcgcgatagcgaatcgccaccccaggttttcaataaccgtatagccaccatcagtgcttccgattcacgatgggtaagcatcaagggcggcagatcaaaacccgccattaaacggtatccgctccccgcttcaccttcgacaggcacaccggataacgacagatcgcgaatatcgcgataaatcgtccgttcagaaaccgcaagccgctgtgccaacagcgctgccgtcgtcagtcgtctaccccgcaaaatttgcacgatctgaaacaaacggtcagcgcgtctggtcatattgactctctacatttagcaaatatcacgcaggttgatgtaaacctattcggttaccttcgctgtcaataaacaacgcgatggttccaatgtcatctccgggaaccatgggttccagaacacacttgccaccggcaaggacgacacgttcaatcgaggctaacaaatcggcggtatgcagataaataacgactccctgcgcaactggagcgacatcatcctgctttatcagcgctccgccgggtccgggttcagcatacgggaatacggccaggtccgccccatccatggtttcccgacgtaacgatatctgcatcacttgctcataaaaggcgattgcacgcgccatatcagtaactggaatttcaaaccagttaatcaagtttttcatacatcctcctgcgagtgtgggtaaattcatgaggagtgtatgacagggctcctgacagcatactgtcagtaatgtttatcgtcatggtacataaataaaaaatcccgatcgcatgaccgggattcagataacacttaaatacgtgtttacggcagaatggacggctgatccgccccttctttttcgactttctgctgcagcatatgctcgcgcttcataccgagtttcagcgccagcgccgatgcgacatagatagaagatgccgtaccaatagagacaccgatcagcatcgtcagcgagaagccttccagtaccggaccgccgaagaggtacagcatcagaattaccactaacgtcgtaccggaggtaatcaacgtacggtgtagcgtctgggtcagcgacacgttaaagatttcgtaaggcgtcccgcgacggattttgcggaagttttcacgaatacggtcggagaccacgatactgtcgttcagcgagtaaccgatcaccgacatcaacgatgccacaatggtcaggtcaatctcaatatggaaaagcgacagtatccccagcgtaatgatcacgtcgtgcgccagcgcgatgaccacccctgccgccagtcgccactcaaagcggaaaccgacataaacgaggatagagatcaacgccaccagcagcgccatggcgccggtttgcgccagatcggcgcccacgcttggccccacgaattcaatacgcttcacggccgcgttctggttggtggcttcattaatgatcgtcaccactttgctacccagtacctgaccgccggtttcaccttcggttggcggcatacgcaccataatgtcgtgactgctgccaaagttctgcaactgcggctcttcatagcccgctttttgcagcgcttcgcgcatcacgtccatttcagccggtttttccagcgtgatttcaattaccgtaccaccggtgaaatccagcccccagttaaacccgcgtacgcccataatgacaatggccgcgatcagcaacagcccggagatgccgaatgcccagaagtcccagcgcataaagtcatagactttacggccgtggtttagttgttcaacagtgtattcctgtgccacatcgcactcctcagattgacagcttagtgacgcgcttgccgccatatagcaggtttacgatagcacgcgtaccgataatcgcggtaaacatcgacgtcgccacaccgataccggtcgtaatcgcgaaccctttaattgccccggtaccgacagcatacagaatgatgactttaatcagcgtcgtgatgttcgcatcgaagatggaactgaacgcgccggcatagccttcgtttatcgcctgctgtaccgtgcggccattactcaactcttctttgatacgttcgttaatcagaacgttggcgtcgaccgccaccgcaagggttaacacgatacccgcaatccccggcatactgagcgttgcccccggcaacagcgacatgataccgacaatcaacaccaggttagccactaacgcgctggtcgcaatcagaccaaacttcttatagaagaagatcatgaacaggatggagaccaccagaccggccagacaggcttccaggccctgcttgatgttctgcatacccagagtcgggccaatggtgcgctcttcaacgatctgaatcggcgcaatcagggcacccgcacgcagcaacaacgagagctgacgcgcttcgttcgggttgctgataccggtaatacggaagctgttacccagccgagactggatgttggcaatgttaatcacctcttcctgtttcaccagtacggcgcgaccgttagcgtctttcttaccgctgtctttatactccacaaacagggtcgccatcggtttgccgatattgtccttagtgaagttagacatgatattgccgcctgcgctatccagcgagatgttaacctgcggttggttatattcatcctggctggacgtcgagtcggtgatatggtcgccggtgaggatcacgcgtttgtacaataccaccggctgaccttcgcgggtctgtttcacttcggaatcgcccggtacgcgcccggcagcagcggcggcctggtcaacgttggtattcaccagacggaattccagcgtcgcggtcgcgccgagaatttctttcgcgcgagcggtatcctggatacccggcagctcaaccacaatacggtctgcgccctggcgttgtacgacaggctccgcgacgcccagttggttaacacggttacgcagaatattaatgttctgctgaacggcgtattcacgcgcttcgctcaggcgcgcatcggtcattaccgcgcgaagttgattgccgctctggctggaaatcaccaggtcacgatgacgcggcgtcagataggcgatcgcctcatcacgcgctttgctgtcacggaacgtgatgctcagcccataattattttctttacgaacggtggtataaggaatgcctttttcacgcagatcgctgcgcaggctatcgatattttgttcctggagtttacctaacgcggtatccatatccacttccatcaggaagtgaacgccgccgcgcagatcaagaccgagcttcatcggatcggcgtgaatagccgccaaccagcgcggcgtagccggcgcaaggttaagcgccacgacatatttatcccccagcacgctcatcagcgcttcacgggcgcgtagctgggtatcggtggtgtcgaagcgcgcaagaatagcgccctcttccagtgccacagacttagcgggaattttttcttcttgtaacgttttctggacctggatcagcgtttgctcactggcggcgacgccgcgcacgccagtgatttgaacagccggatcctcaccatacaggttgggaagtgcgtaaagcaggccgacgataatcacgacgaccagcatgatgtacttccacaaaggataacggtttaacacggcagttccctttgggaaaacgaaatattacagcgccttcatggtgcctttcggcagaacggcagctacgaagtcacgtttgataaccacttccgtggtgtcattcagcgcgatggcaatgtagccggcttccgctactttggtcactcgaccaaccagaccgccattcgtcagaacttcatcacctttcgcaatggagtccatcagctttttgtgctctttggtgcgcttctgctgcgggcgcaggatcatgaaatagaaaatcagaccaaacaccaccagcattaaaatcagagacatcgggctgccctgcgccggagcacctgttgccgctaccgcatcagaaataaaaaagctcattcaaattccctcattattaaaattaatcaacgttcaaaggtggaacgggtcgcccctgacgttggtaaaactcggttacgaagctctctaatttaccctcttcaatagccttgcgtaaacccgccatcaaacgctggtagtaacgcaagttatgaatggtattgagacgcgcacctaatatttcgttgcaacggtcgagatgatgcaagtaagcgcgtgaataattgcgacaggtgtagcaatcgcactcggcgtcaagcgggctgatgtcgcttttatgctttgcattacgaatcttcaccacgccgtcggtcacaaacagatgaccattacgggcatttcgcgttggcatgacacagtcaaacatatcaataccgcgacgcaccccttccaccagatcttccggtttacccacgcccatcaggtaacgcggtttgtcagccgggatctgcgggcaaacgtgctccagaatgcggtgcatatctgctttcggctcaccgacagccaaaccgccgacagcgtagccatcaaagccaatctctaccagacctttcaccgagatatcgcgtaaatcttcgtaaacgctgccctgaatgatgccaaaaagcgcattcttattgccaaggctatcaaaacggtcgcggctacgcttcgcccaacgcaacgacatctccatcgagcgtttagcatagtcccagtctgccgggtacggcgtacattcatcaaagatcatcacgatatcggaaccgagatcgtactggatctccatcgacttttccggatcgaggaaaatcggatcgccgttgatcgggttacggaagtgcacgccttgctcggtaatcttacgaatatcgccgaggctgaagacctggaagccgccggaatcggtgagaatcggccctttccactgcatgaaatcgtgcaggtcgccgtgcagcttcatgatttcctgacccgggcgcagccacaggtggaaagtgttgccgagaataatctgcgcgccggtcgcttccacttcttccggcgtcatgccttttaccgtaccgtaagtacccacaggcataaaagcaggcgtttccactacgccacgatcaaacaccagacgaccgcgacgcgcgcgaccatcggtggtatctaactcaaatttcattatcactcctgcgtcagaaaaacagtccgacgtttaacgactcgctacggaatgattccatagctaataaattcccgaaggcgtcatcggcgcagccagtttggagtcggccagcgcacaaccaccggagcgtacacgcagtacgtgaggatggcgagcactgcccggcgtcaaaatggcaagtgagatagccttcttacggacgctcagaaatagcctgcggattgcacgtgataaacatcgcgtccccgtagctaaaaaagcgatatttttgttctaccgcagtcttataggcattcatggtgtgttgataaccggcaaatgcggaaaccagcataatcaacgtcgattccggcagatggaagttggtgatcagcgcatcaatcactttgtattgataacctggataaataaagatttgcgtatcgccgaagaatggctctatcaaatcgctttttgccgcctgcgccgcgctctccagtgagcgtaccgaggtcgtgccgacggcgataacccggttgccgcgcgctttcgccgccagcaccgcgtcgaccacctcttgcggcacctcagcatattcggagtgcatgatgtgatcttcaatggtatcgacacgcactggctggaaagtgcccgcgccgacgtgtagcgtaacaaacgccatttcgacacctttctcacgaagcgccgccagcagcggctcatcaaagtgcagccccgcggtcggcgcggcgacggcgcccggtttttcactgtaaaccgtctgatacagttcgcggtcggcgtcctcgtccggacggtcgatatacggcggcaacggcatatggccgatggcgttgagaatatccagcaccggacgcgggtcattaaactcaacttcaaacagagcgccgtgacgcgcggtcatggtcgcgtgaatactttcgtcatcgcccagtagcagttccgtgcccggttttggcgctttagaagcgcgaatatgcgccaggatgcgtttatcatcgagcatacgttcgaccagcacttctatcttgccgccgctggctttacggccaaacaggcgcgccgggatcacgcgggtattattgaagaccagcaaatcgccagggttgagcttatcgagcagatcggtgaaagtaccgtgcgtcagcgcgcccgtcggcccctctaatgacagcaaacggcagcgactgcgttccggctgtgggtagtgggcaatcaaggattcgggtagttcaaaggaaaaatcggtaacgcgcatgactctgactcagactaaaataagaggcgggtagtctagtgccggggcgttcccgctgcaaccgttacccgctttttggacagagaatcaataatgaattttcttgctcacctgcatctggcgcaccttgccgacagctcgctttccggtaatctgctggccgattttgtccgcggtaacccggcaacgcattatcctcctgacgtggtagagggtatttatatgcatcggcgtattgacgtcatgaccgacaacctgccggaagttcgtgaggcgcgagagtggttccgccatgaaacgcggcgcgtggcgcccattacgctggacgtcatgtgggatcattttttatcgcgccactggacgcaaatctctcccgattttccacttcaggcgtttgtcggctacgcccatgcgcaggtcgcgacgattctgcccgactccccgccgcgctttgtcaacctgaatgattatctttggtcagaaaaatggttagagcggtatcgcgatatggatttcattcaaaacgtgctgaatggcatggcgaatcgccgtccccggctggatgccttgcgtgattcctggtacgatctggacgcgcactacgacgcgttagaagagcgcttctggcatttttatccgcgtatgatggcacaggccgcccgcaaagcgctgtgacggcctgatagcgagggcgtgcgtcagatccgccgttggcagaaagatcgttcgctgtcataaaggagtcatcattacgatttataatgacccgatcgataggcaaaagctgtctcattgattgtcaagaccgcattgttttgtcgcttcgccctccctatactgcccgcgttgcgttctaaaacccttaatattgcaggagaattattatggtactggttactcgtcaggccccggatttcaccgctgcggcggtactgggtagcggtgagattgttgataaattcaacttcaaacagcacaccaatggtaaaacgaccgttctgttcttctggccgatggacttcacttttgtttgcccgtctgagctgatcgccttcgataaacgttatgaagaattccagaagcgcggcgttgaagtggtcggcgtttctttcgactctgagttcgtccacaacgcatggcgtaacacccctgtcgataaaggcggcattggcccggtgaaatacgcaatggtcgctgacgtgaagcgtgaaattcagaaagcttacggtatcgaacatccggacgaaggcgttgcgctgcgcggctctttcctgattgacgcaaacggtattgttcgccaccaggtcgtaaacgatctgccgctgggtcgtaacatcgacgaaatgctgcgtatggtcgacgcgctgcagttccacgaagagcacggcgatgtctgcccggcgcagtgggaaaaaggcaaagaaggcatgaacgcctctccggacggcgtggctaaatacctggctgagaatatttccagcctgtaagtcagtgcattgataaaaggctcgcgaatgcgagccttttttatgcgtgaggtattatgaaccacctcgcctcaacgattcatccataccgtcgcggaaatcgcgggtaaactaagtcttccctcgcggatgtcaccgcttcccgttttacattgccatccggccacgttcagcaacggcaacgcttccagcgccacttcacaggcctcgccccggttaatcgccaccagcgcccgctgctgctgataaactcgcacgaataccactacgtcaccttcggcatacagcgcctggcatccgccacgacgcagcgccagactgctctggcgcagtttcgccatacgctggtacagcgccagcaagttgccgtcctgcttgcgttcatcccatgggaacggtttgcggcacatggggtcatttgcgccgtccacgccgacttcatcgccgtaataaatacatggcacgccgggccaggtaaacagccagaccaccgccagcggcaggcgcgccgcgtctttacccagcagggttttaaagcgcgcagtatcatggctgtcgagttgattaaacatgcgcagttgctgctggtgcgataatccggcgcggtagttatccatccacgcgatacaggtccgggcatcaatatgctgtggttcgtaagcgatatcagtattggcgagaaatccccacagcgggaaggtgaagccgcgataattcatggcggcatcttccgcatcggcctgtagccactgccgcgcatcgctgaaatgttcccccacaatataggcttcaggctgcgcctcttttgccgcccgggtaatgccggcgacgtgctgcaaattgtggcgcgccccgcccgcctcgcccagcatatgtacgacatccagccgccagccgtccatattccacggtgcctttagccagtgacgaacgatactgtcctcaccgcgatagatctcatccaccagcgtttctgattgataatcgagtttcggcaggctcggataacccagccagtccagcgccacgccttgtggtgaaaaggagtaccagtcgcgccacggcgagtccgggtgatggcacgcgccgccagtgctgcggttatgcctgtcaaaccacgcatgcgagtcgccgctatggttaaacacgccatccagcaccagcctcatgccctgtgcttgcgtttcacgccgcaggcgtagcagcgcccgatcgccgccaaattgcggatcgacatggcgataatcttccgtgtcgtacttatggacgctcggcgcggtaaataccggattcagatatagcgctgtgacgcccagttttttcagatacggcagcttctcacaaatgccattcagacagccgccgtaaaaggtggaaccgcccgcctggggggttaaaggatcgtcccagtcgcgcagcacaatctcctgacccgcggcatgatggtaatacactcggtcctgatcggcttcacgcgtcgcgctgcgggcaaaacgatccgggaagatctgataaaaaatttgatcggcgacccactgcgggccgctatccggcacatcaaccgcaaattgttccagacgcgcgggtggaaagcagctaaatccctgcggcgtaaaccatcgctggcggtcatgccaaagcaatttaaagctgtaacggcgacggggctgccctaacgcgatattgagcgtcgctcgccacgccgtcacgcccggctgcggctggcggcgctgtttgcgcatcgccagtgagatttcttcgttatcgaattctgagcgcaacgtcacgcgagacggcggattttctccgctcagccacagcgtaatggttaatttatcgttatgttgcttaacaaacggggcaaccggtaagtgccaggcattcaacatctcgtatcccctctactaaaaatggggccaccttgccacagagatttaaaggataactcatcatccgggggtttattaggggaggagactccaggaggagaaacggctccgcttatccggcctgccgttgcctgcagaccggataaggcagagaaaaacgactacgcctgcgccaattgacggtcgcgacggcgtttaaatatccagccaatcaacagcagaactatccaggcgaagcccacatacagtgagatgcgggtattcggatggtagccgataagcgcaataatgaagaccaggaaaatcagacccgctatcgtcgttacgacaccgcccggcaccttaaacttcagcgcttttacctcttccggcggtaaacgacgacggaaggcgatttgcgacagcaggatcataatccatacccataccgtcgcaaacgtcaccagcgaggcaatcaccaggaagacgttttccggcatgatgtagttcaggtaaaccgcaaacagcagcgcaatcgtcatcaccagcacagtgacccacggaataccacggcgtgacgttttggcaaagactttcggcgcgctcccctgctccgccataccatgcagcatacggcctacgccaaacacatcggagttgatagcggaaagcgaggcggtcaataccacaaagttcagaatgctggcggcaaaggtaatccccatatgctggaacgtcagcacaaatgggctgccgtttgtgccgacctgattccacggatagatagacataatgacgaacagcgtgccgacataaaataccaggatacgcatcggtactgagttaatggcgcgcggaatggatttctccgggtctttcgcttccccggcggtgataccgataatctcaatcccgccgtaagcgaacatcaccatttgcagcgacatgatcattcccagccagccattgctgaagaagccgccgttgctccacaggttatgaatgccagtcggctgcccgccgttgccaattccccacacaatgatgccgatacccgcgacaatcatgataataatggtggcgactttgaagaaggagaaccaaaactccagctcgccgaacatcttgacgctcatcaggttgatggcgcaaatgatcagcaccacgctaagcacccaaatccagtgcggcacggcggggaaccagacccccatgtaaatgccgaacgcggtcacgtcagcaatggcgacgatcaggatctcaaaacagtaggtccagccggtaatgtagcccgcaagcgggccgaggttttcctgcgcatagcgcgaaaatgagctggcggcagggttgtgaacggacatttcccccaatgcgcgcataatgatatatgccgcgaccccgccaataatataggccaacagcacgctcggccccgccattttgatggcgtccgccgagccgtaaaacaggccggtgccgattgccgaacctaatgccataaagcgaatgtgccgggtgctcagcccacgctttagcttattattgctttccatcaatttctgacctatcaacacaataataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaccacggggcgttaagccccgtggtgtacacatatgtcagcgattttagtgagcgctggaggtcacctgccgacccgccgcgcgatcccagataatcgccaggatcaccatcaccaccgttggcatcaaccacgccagtccctgttccgccagcggcaaacgctgactccaggctggcagcatatcgccaaaggcagatgctttgatgccgtcaaggataccaaaaagcaggctgataaacatggccggcgcgatgatacgggtggaattatgccaccatgagcgggtaaaacttaatacaaccagtgcgatacacggcggatagatagccgtcagcaccggaatggagatttgaatcagatggctcagtccgagatttgacaccaccatagagaagccgccgagaataaagaccagcgtgcggtaagacagcggaatatactgcgcgaaaaactcagcgcaggcgcaggtcagccccaccgccgtcaccagacacgcgataaagatcagcgccgccagcaggaagcttcccgcgccgccaaaggtatgctgaacgtaggcatgaagaatcgccgcgccgttcgctgactgatcgaccagcgtcgcgctgtcagaacctaagcgaaacaaggcaaggtaaagcagcgtcagccccacgcccgccatcaggccggcccagaccgtgtaacgcgtcaacaggcgcgcttcggtcacgccgcgagaacgcgccgcgttcacaataacgataccaaacaccatcgcgcccagcgtatccatcgtcagatagccgttcacaaatccgttagaaaaggccgcattctgataagcgtccagggcgttgctgattggaccggcaggccaaacgatagccgcgacggacaggatgaccagcgcaataattttcaacggcgccaggaaattccctaccgtatccagcagcttacccggatagagggaaaccagaataacgatagcgaaatagaccacgctgtaaatcagcaacggcattgcagaatcgccggtcaacggagcgataccgacctcaaacgacaccgtcgcggtacgcggcgtcgcaaataacggcccgacggccagatagcaaacggtcgccagcaggagtcccgccactttaccaatcggcgtactgaggctgtctacgccgccgccgactttcgccagcgccacaacagtaagaaccggtagccctacggcggtaatcagaaagccaatagcggctgtccagacgtgttcacccgcctgcaaaccgaccataggaggaaagataatattgcctgcgccaacgaacagcgcaaatgtcataaagcccagggcgatgatatcgcgcgattttaactgatgggtcataaagtcttactgcctgtggatggtgatgttgtaaacattaaaatttttgcctttcccggaggattataaagcggcgttttttatcaatttcagcgggaaaaactcccggaccgatgcggcgaagaattgtttttcgatttaccgcgcaaatgcagtcgtaatgacagcacctgaagcgcaatttaaacgcttataacgttttaaagcaaggtgggatctaaaaaccagatgaatatcgcgatatgaaatttacaaccagaataaaacaccattctcatgaaaaagttatggctaatcatgcgaacaaaaaatcaccaaacgttgaatgtttcaacgagcccgtcttaactgcaaagaaaataagccagcatccgctggcttatggaaagttatacttacgaaaggcaattaatcactatttttggcaattaaacgttccggcagcacaaagctaaatcgcgttcctttgccaggcgaactgtcgatttcaaggcggctttcatggtgattcaacgcatgtttcacaatcgccaatcccaggccgctgccgcccgtttgccgcgaacgcgctttatcgacgcggtagaagcgttcggtcagacgaggaatatgctcggcagcaatccccggaccgttatcttgaatgcaaaattcagcgccatgcgcggcacgtcgccagctcaccgtaatatgcgttcccgccggcgtatggtttactgcgttatataccaggtttgagatcgcgctacgtagctgctcttcattgcccagaacgctaagactatcgtcgaccgcaaacgtaaaggtatgtttctgctggctgagcgtctgcgcttcacgctccacgacccgcagcatcatcggtacatccactttttcatttaataacagcgccggggccacctcaattttagacagcgtaagcagttgttttaccagcccttccatacgatacgtttgctcgcgcatcgtatgcagcgctttctctcgcgtcgccccttccagcgcctgttcctgcatcatttccagatagccttgcaataccgtcaatggcgtacgcaactcatggctaacgttggcgaaaaagttacgtctggcgccttcaagctgatgcatttgcgtcacatcgcgcgccaccatcaggagttgtttatcggtataaggcatgacgcggatctccagatgccgcccggtattgagcaccaaatgaagcggacgggtgaaatcacgcgtttttaaatactgggtaaactccggataacgcagtagattgagaatattctgcccgttgtcatccggccagcgtagccccagtatctgttgcgccaaaccgttacaccaaaaaatgccgccctcttctgtggtcagtaccacggcatcaggcagcgactccgcgccgctgcgaaaacgtttaatcaggttccccagctcgcggcgacgcttcttatttcgcaactgcatctggtgtaaaccgtataacagcggttcccaacttccccgccccggcggcggcgtcatacttctgtcgacccaaagccaccaggagaggcgtaacaaattccagaaatgccagacaagcagtcccgtcaccgccgccagtaaaaaccacggcagataaccaaaaaaagcgctaaggataagcgcggggatgcaacagagcaccagctccagcaccagccttttccatgacagccgttccagcacgcgtcatactccctcaagaatggaaagccttctccgccagaaacctgtgatcaactggcggaaaaggcattaaaagcgggtcgaaaaacgataccctgtcccgcgtaccgtttgcaccatccggtcgtggccgctgtgctccagcgccttacgcaaacggcgaatatgcacgtcgaccgtccggtcttcaacgtacacattggtgccccagacatgattgagcagctgttcgcggctgtaaacccgttccgggtgcgtcataaagaaatggagtaatttaaattcggtcggccccatatccagcgggctgtcgccggtcatcacgcggtgagagccaggatcaaggctcagtccctgcatctcgatcacctcttcgaccgccatcggcgagatacgccgcataacggctttaatgcgcgccaccaactccttgggggaaaacggcttggtaatgtaatcgtcagcgccggtttccagcccgcgcacacgatcttcttcctcacctctcgcggtcagcataaccacaggaatatcccgggtcatggcctcacgtttgagatgtttaataaactgtaaccctgacccgccgggcaacatccagtcaagaaggatgagatccggccagggttcattaagtttattcaccgcactgtcataatcttcggcttctacgggctgaaagccattttgttcgagcacgaagcacaccatttcacggatcggcgcctcatcttctacgaccagaatacgtctcgccataatttgccctgttagtcgttagttatcaatgccgcgccattatgcgtcagatttatgacagatttatgaaaaaaaaaggcggcattgacagcatgttgatgatttatgacaccggtgaaaccgtgcattaccgtgtaccggcggtaaattgcgcccaaaaatggaggggatgacgtgtataatcccgttcacgctttttttgcatggaacaattatgcgcatcctccacacctctgactggcatctgggacaaaacttctacagtaaaagccgcgccgcggagcatcaggcttttctggactggctgctggagaccgcgcaggcccatcaggtggatgccattattgtcgctggcgatatttttgataccgattcgccgccaagctatgcccgagaactttataaccgtttcgtcgttaatttacagcaaacgggctgtcatctggtggtgctggccggtaatcatgattccgtcgccacgctaaacgaatcgcgcgacattctggcgtttctcaatacaaccgtgatcgccagcgcgggctatgcgcctcggctacttcatcgtcgcgacgggtctccgggcgccgtactgtgccccattccctttttgcgcccgcgcgacattattaccagtcaggcgggattatccggcagcgagaaacagcagcaacttcttcatgcaattgccgattattatcaacagcagtatcaggaagcgtgcctgctacgcggcgaacgaaagctgccggttatcgcaacgggacatttaaccaccgtcggcgccagcaaaagcgatgcggttcgcgacatttatatcggtacgctggatgcctttccggcgcagcatttcccccctgcggattatatcgcattgggacacattcaccgcgcgcaatgtgtcggcggcacagagcatatccgctattgcggctcgcccatcgccctcagctttgatgagtgcggcaaaagcaaatgcgtgcatctggtgaccttcgaccagggaaaatggcaaagtaccgaaagtctggctgtccccgtgactcaactgttggcggttttaaaaggcgacctggcgtcaattaccgaacagcttgagcagtggcgcggcgttgagcaatcgccccccgtctggctggatattgaaatcaccaccgatgattatctgcatgatatccaacgcagaatacaggcattaacggagtcactccccgtagaggtattactggtgcgccgtagccgcgaacagcgtgagcgctcgctggcgaacgagcggcgggaaacattaagcgagcttagcgtggaagaggtttttgcgcggcgtctggcgctggaagcgttagataccccgcagcgcgagcgcctgaatcagctcttttccagcacgctctacgcgttgaatgaggagcatgaggcatgaaaattctcagtttgcgtctgaaaaacctgaactcgctgaaaggagaatggaaggtcgactttaccgccgaaccgtttgccagtaacgggttattcgccattaccggcccgaccggcgcgggaaaaaccaccttgcttgacgccatctgcctggcgctgtaccacgaaacgccgcgcctgaatacggtatcgcaatcgcaaaacgatttgatgacgcgcgatacggcggaatgtctggccgaagtggagtttgaggtaaaaggcgaagcctggcgcgcgttctggagccagaaccgagcccgaaatcggcctgacggcaatctccaggccccacgcgtggagctggcgcggtgttcagacggaaagatctttgccgataaggtaaaggataaactggagatgatcgccacgttgaccgggctggactacgggcgcttcacccgttcaatgttgttatcacaggggcagttcgccgcctttcttaacgccaaagcgaaagagcgcgcagagcttctggaggagctcaccggcactgagatttacgggcagatctccgcacaggtatttgaaaaacataaatcagcccgtctcgaactggaaaagttacaagcgcaggccagcggcgtcgccctattggcggacgaacagttacagcaactggaagccagtttgcaggcgcttactgacgaagagaaacgcctgctggccgaccagcagggacagcagcagcaccttcactggctgacccgaaaaaacgagctccacactgaattacacgcccgacagcaggcgctgtacgcggcgcaagaggcgcgagaaaaagcgcagccgcagctcgcggcgctgacgctggcgcaacctgctcgccagttgcgtccgcattgggagcgcattcaggaacaaacccgcgccgttgagcgtgttcgccagcacagtgatgaagtgaatgctcgcttacaaagcgcgtatcgcctgcgccagcgtatccgcgcctgcgcgcatcgacaattcacgcaactgaacgccacagggcagcggttgaagacatggctggcggaacacgacggcatccgcgtctggcgcagcgaactggcggggtggcgagcattattaacacaacaatcccacgaccgggcgcaactgagccaatggcaacagcagttgctgagcgatatgcgtcagcgtgatgcgctaccgccgctcacgctcgacctcacgccacaggcgctggcggaagccagggcattgcatacccggcagcgtccgctacgccatcgtctcgccgcgcttcaggggcaaattctcccgaaacaaaagcgtcaggcgcagctacaggcagctatcgcgcgtcatcatcaggagcagacgcaatacacccaacgtctggcagataagcgcctgagttataagactaaagcgcaggagcttgcggacgttcgcactatttgcgagcaggaggcgcgcatcaaagatctggaaagccagcgggcgcacttacagtccggccagccgtgtccgctttgcggctcgacgacgcaccccgccatcgccgcctatcaggcgctggaactgagcgcgaatcaaacccgccgcgacgcgctggaaaaagaggtcaaaacgctggcggaagaaggcgctgcgctgcgaggacagttagatgccttaacgcaacaattacagcgggatgaaagcgaggcgcagtcgttgttgcaggaggagcaagcgcttactgaggaatggcaaacgctgtgcgctacgctgggcgttcagctccagccgcaagaagacctcgctggctggctgaccgccgcggaagagcatgagcaacagttggatcagctcagccagcgtcatgctctacaaacgcaaatcgcggcgcatactgaacaggtagcgcgctttaccgcgcagattgcacagcgtcaggcgtcgctgacggctgatttggcgcagtatacgctttcccttcctgcgccagaagacgaggcatcctggctgaatgagcgcgccgacgaagcgaaaatatggcaacagcgtcagacagagttcgcggatttgcaaacgcagatcgacaggcttgccccgttgctggagacgctaccgcaaacggataccgcggattccgacgacgacgtgccgctggataactggcggcagacgcatgatgagtgcgtgtcattacaaagccagttgcaaaccctgcaggaacagacgacgcaggaacagcagcgcgccgccgaggcgatagcgcactttgatgcggcgttaaaaaatagcccgtttgacagccaggcaacgttcctggcggcgttgctggatgaagagaccgtgacccgtctggaaaaacaacaacaaacgctggaaagtcagctacaacaagcgaaggcgttaagcgcgcagtccgcgcaggcgctggctgaccatcagcaacagccacccgccggtctggacccaacgtgtacggcggagcagctcgcgcagcggctggcgcagttggcgcaacaactgcgcgagaacacgacacgccagggggaaatccgccagcaaattaaacaggatgcagataatcggcagcgccaacgggcgctgatggcggaaatgaagcaagcctctcagcaagtggaagactggggctatctcaatgcgctgatcggctctaaagaaggtgataagttccgcaaattcgcccagggactgacgctggataatctggtctggctggcgaatcatcagctcacccgcctgcatggccgctatttattgcagcgcaaagccagcgacgcgctggaactggaggttgtcgatacctggcaggccgacgccgtgcgcgatacgcgaacgttatcaggcggcgaaagcttcctggtcagcctggcgctggcgctggcgttatcagatttggtcagccataaaacgcgcattgattccttgttcctggacgaaggcttcggcacgcttgatagcgaaacgctggacgccgcgctggatgcgctcgacgcgctgaatgccagcgggaagaccatcggtgtgattagccacgtggaagccatgaaagaacgtatccccgtgcagataaaagtgaaaaaaaatcaatgggcttggttatagcaaactggacaaagcgtttgccgtggagtaacgcgagtgtcatcctgcgcacagcataccgtcatgacatagcataataatgaatacacaaagacgaataaggaatggtattacctcgcgcttatccgcaagctatacgttgattggctgtgacaattcatagccacagcgcgcgacatgcgtcttcattttcggcaggtggtatgaaaaaagttattttttctttggcgctgggtacgttcggactggggatggccgagtttggcattatgggcgtgctgacggagctggcacgcgatgtcgggataacgattcccgccgccgggcatatgatctcgttttacgccttcggcgtcgtgctgggcgcgcctgtaatggcgctcttttccagccgcttttcgcttaaacatatactgctgtttctggtcatactgtgcgtgatgggcaatgccatatttaccttttcctcgtcatatctgatgctcgccgtcggcagactggtttccggctttccacacggcgccttttttggcgtcggtgccattgtcttgtcaaagattatccgccccgggaaggtcaccgccgccgtcgcgggtatggtttcagggatgacggtggcgaatctggtgggcattccgttcggcacttacctgagccaggaatttagctggcgctacacctttttattgatcgcggttttcaacatcgccgtgctcaccgcgattttcttctgggtgccggatattcgcgacaaagcccaaggcagcctgcgcgagcagttccacttcttgcgtagccccgcgccgtgactcattttcgccgccacgatgttcggcaatgcgggcgtttttgcctggttcagctatatcaagccatttatgatgtacatctccggtttttcggagacgagcatgacgtttattatgatgctggtcgggctggggatggtgttaggcaatctgttaagcggcaaactctccggtagatatacgccgctgcgcatcgcggtagtgactgacctcgttatcgtgctctctctcatggcgctctttttcttcagcggatacaaaacggcatcgctgactttcgcgtttatctgctgtgctggtctgtttgcgctctctgcgccgctgcaaatcctgctgctgcaaaacgccaaaggcggcgaactgctgggcgcggcgggagggcaaatcgcgtttaatctcggtagcgcgattggcgcctggtgcggcgggctgatgctgacgctaggttttgcgtaccactatgtggcgcttcccgccgccctgctctcgttttccgccatgtcgtcgttgctggtatacggacgtctaaaacacaagcagccatcggtcacgccggttgccggatgacgccatccggctagaaacgttacgccagcggccacagccaggccgcgccgcgcacgccgctcgaatcgccatgccgcgccttacgtaccggcgtctcgcactcgccgccaaaaacaaacgatttcatcagcgacggaaccgttttgtacaggcgctcaacattgctcataccgccgcccagcacaatgacatccggatccagaatattcacgacatgagataatgccttcgccagccgtagctcataacggcttatcgccagttccgccacggcgtcctgcgcgtcgaccagacgaataatctcatcgccttttagcgttttaccgctcaaacgctggtaatccgtggcgaatcccgtaccggaaataaaggtttcgatacagccttgtttaccgcaataacagggaatttcttcgcggtaacgcaactcatcgtcatccatccacggcaacggattgtggccccattcgcctgccgtaccgttgccgccgatgtgcgcccggccatttagcgctacgcccgcgccgcacccggtaccgataatcaccgcaaataccgtttgcgcccccgccgccgcgccatctaccgcctctgataccgccaggcaattggcatcgttggctaaccgcacttcacgcttcagacgacggctcacatcgctatcgaacggctggccgttaagccacgtagagttagcgttttttaccacgccggtgtaaggcgagagagaaccgggaatgccaatgccaacgctaccggtctggccggtcgcctgttccgccatgtcgaccagcgtagcgatggtttctatcgtttgctgataatcctcccgcggcgtaggcagacgatggcgaaaccgctgctctcctgcatcatcaagcgcaatgacttccgtttttgtgccgcctaaatcgataccaatacgcacataccgctcctcattttttgggaatatcaacagggtagaattcaccgttctgattggcaatgcaagcctgccgacaattcgttactataccgactggatttaacgacaaggccgtggaaattatcatgctgtggttcaaaaatttaatggtttaccgtcttagccgcgatatcacattacgcgccgaagagatggagaaacagctcgcctcaatgacgtttaccccatgcggtagccaggatatggccaaaatgggctgggttccgccgatgggctctcacagcgatgcgttaacgcacaccgccaatggccaaattattatttgcgcgcgcaaagaagagaaaatcctgccatcgccagtgatcaaacaggcactggaggcgaaaatccagaaactggaagccgatcagggacgcaagctgaagaagacggaaaaagattccctgaaggatgaagtgttgcattcgttgctgccgcgcgcgtttagccgcttcagtcagacaatgatgtggattgataccgttaacggcctgattatggttgactgcgccagcgcgaaaaaagcggaagatactttggcgctactgcgtaaaagtcttggctcgctgccggtcgtcccgctggcgctggaaaatccgattgagctgacgctcaccgagtgggtgcgctccggtacggtcgctcagggtttccagttgctggacgaagccgaattgaaagcgatgctggaagatggcggcgtgatccgcgcgaaaaagcaggatctggtcagcgacgagatcgccgttcatattgaagcgggtaaagtggtcacgaagctggcgctcgactggcagcagcgtattcaattcgtcatgtgcgacgacggctccattaagcgtctgaaattctgcgatgagctgcgcgatcagaacgaagatatcgaccgggaagattttgcccaacgttttgatgcggactttatcctgatgaccggcgagctggcggcgctgattcaaagcctggtggaaggattaggcggcgaagcgcagcgctaaccagagggtccctctccgccggagaggggactcaccgttacaaatagcggcacagatacgaggtgggctcagcgacctgtagatgaaactcgctgtggccaggcacgttaaacacctcaccggctgtatacactttccattcgacagttcccggcaacagtaccttcaacgcgccgctcacaaccgtcatctcttcgggttcggcggtgccaaatgtatactccccttccgccatcacaccaacgctggcccggccggtgctactgctggtaaatccaatagacttcactttcccggaaaagtattcattgctttgtagcataatcaggccccgtctcattattaaattaacacccaatatagagtcctgacgttcggcctgtcacgtaaaattagacaagcagttctgaagctaaccgcgcaatcaaaacattagagagtaaaaccggcacatccagcgcctgctgtaaaatatcccgatgacgctgatgaaaacccagacaatccagcataatgacgtccgcgccttgatccagtagcgcctgcccggcatcaattaactgttgctcagaaccgtgaaccggattcgccagcgaatacaccggcggcatttgcaatacctgccattttttctcctgggccgccagaagttctgcaacaggcacaatcgcgcccacctgatgtccatccacaatagaggcgacaagcggtggaataatacgcagcggttcaagcaaaatagaattacgggctgccgtacttttaatcgccgcggtgctcatcagtataatgacatcgtaaccctgattatccagcacctcgacaacgctctgtaaatctcgctccactttctggcgggaaacatgggctatctggttatcattcagcaacgtcaaaagcagatcgtcgccaggctctacagcgtaatccgccataacgtcttcccggctcatttttcccagcaggctatgatgggttatgggttatgtgttgttcgtcgatgtattccgtcagaagcggtaacacttcgctcattggcacaacgccgattgtgaggattgccaacgacgcactcatttttattccaccttattacttcgtcgtaattcccgggcaaatattcacacgctcaccgcgctacctgccctacaaatctcagaaagcgtagcagcagatgagcaacgtattgtgtaaagattccaaataactccaatattgtattgttatcgcttaatttatggttttagttgccagtataaatgtttcaagaatgtgatggagatacaatttaggggtactcagaatcccttccgagtggttcatgcgtctatgatttatccggatcttcgtaacgttttttcgcatccatcgcttcttctgcggtcggatgctcgctgatgagcgaatcaggtttcggatggtcagcccgtagctgataccacgtcaccgtctggcccggcgtgcctttttcaatggtgacgatataagcttcccgcggataaggtggtctggttggcatagcgtttcctttattctgggtgagcgttaagtatagacatctccctgtaaccgttgcgtcgacggcggcagcgccgcaataatttcagaaacgacctgggccggcgctttcgtcgcgtcaataatgtaatgcgccgtttcgcgatacaacgcgtcacgctgctcaagcacttcccgaacctcttcgctcaacggcttgccggtgagggtcgggcgcagatccgcttcaggttcagcctcaagccggttaaccagcgtggataccggcgcgcacagataaatcactacgccaacacggtgcatataacgtcggttatactccgtgagaataataccgcctcccgtcgccacgacagtcgaaggcgcgcttaccgcctccagggccgcggtttcccgggcgcggaaccctccccagccttctttttcaacgatatcagcgacgctcatctgcacgtgcgattgcagccagcggtcggtatctgcaaaccgaaaaccggttgcctgcgccagcgccataccgatggtggttttcccacagccccgcgggccaacaagataaagaggttgcatcatagcaggcgttcccccaggaactgcgcatacgcaggatttgatatcagtaatgttataatcatatcatctaactagtacaacgcataaatgtaaataataatttacacaaaggtactaaagtcacaatattagtactatagcaagaatcagaaatgaataaactgtaaatttttcattacatgatttattttttacgctggctttccagccaccacttatccagctcggcggcaaaatgctgacgatcgcgcggcgagagagtgtttggtccccccgtttgtacgccgctggcgcgtagcgtgtccataaagtcacgcatcgtcagacgttcgcgaatcgtggcgtcgctatagcgttctccccggggattaagagccgcagcgcctttttccagcacttcagccgccagcggaatatccgcggtaatcaccagatcgcccgcttcgcattgacgcacaatttcattgtccgccacgtcaaacccggcggccacgcgaagcgtgcggataaaacgcgaaggcggcacgcgcaaggcctgattggcaaccagaataagcggcaactgcatccgctcggcggcgcggtacaaaatttctttaatgacattcggacacgcatccgcatccacccagatggtcataatgtctcccgtacggtatacaatcttttattgtctcgcgcttttgtctttcatcaaagtgctgtttctccttctgcccgttttcaatccgcgttaagctaaccattccccataacacacaaacatagggagtgacgagatggagaagaaaatcggttttattggctgcggtaatatgggcaaggctattcttggcggactgattgccagcggtcaggtacttcccggccagatctgggtctacaccccctcccccgataaagttgccgccctgcatgatcagtacggcattaatgcggcgcaaagcgcgcaggaggtcgctcaggtcgcggatatcgttttcggcgcggtaaaaccgggcattatggtgaaagtgctcagtgaaatctcctccagcctgaacaaagactcgctggtggtctctatcgccgcaggcgtaacgcttgatcagcttgcgcgcgcgctgggacacgaccgtaaaatcattcgcgctatgccgaatacgccgtcgctggtcaacgcaggaatgacctccgtcacgcccaacgcgctggtcacaccggaagatacggctgatgtgctgaatattttccgctgctttggcgaggcggaagtgattgctgagccgatgatccatccggtggttggcgtgagcggatcttcgccggcctatgtctttatgtttatcgaggcgatggcggacgctgccgttctgggcggtatgcctcgcgctcaggcttataaattcgccgcgcaggccgtcatggggtcggcgaaaatagtactcgaaaccggaaagcatcccggcgaactgaaagatatggtgtgctcgcctggcggaacgacgattgaagccgtacgcgttctggaagaacgtggcttccgcgctgcggtaatagaagcgatgacgaaatgtatggaaaaatcagaggcgctcagtaaatcctgaagcccggctggacgtcatgccgccacttcggtgcggttacgtccggcattctttgctttgtaaagcgccatatccgcagactttaaccattcccgataatgaccgatttgtggcgttaacggcgccacgcccacgctgatacgtaacatgacctgcggcgcgcccggcaagcgtaaggtatttagccgttcatgcactcgcgacatggcggtaatcgcgctgtctgccggcgttccgcacataatcaccgcaaattcgtcgccgccaaagcgcccgataatatcactcccgcgtagcgttatctgtaattgacgcgtcagggcgataatagcctcatccccagcatcatgtccccaggtgtcgttaatgctcttaaaatgatcgatatcgataatcaacaatgtcgcctcccgatggtggcgtcggctgtgatcgaattcattacgtaataaaatttcccagtggcgtcggttatagacgccggtcatgccatcccgcgaactcatcgcctgcaagcgtcgcttatgttccgctaatttaatggccgtttgataacttacccaggcgaacagaagcggatacaacataatgacgggcaaagagagcgtgacttccagcgacgagcttcgcatcgcgacgggtagcccggtaagctgcaacgtcaccagacatgacgccagcaaaaggcccattccgacagtgaatagccgccgcccgccagcgcccatcagattcatgctcatcatcataaacagcgcggcggcaggcaacatattgacgcccatcaacgcgatccacatgccggagaggatcgcatccactttcaggttgtaaatttcctggcgtagcggatcaagggctttcgccgcccactgccacgccagatgcggccagacaaaagaccagccgaccagcaataaccaccagccgccaaagacaggttgcgacactaacacggcggccaccggtaaaagcatcccccctaaccccaccgcgcgcggtagcctgatgcgccgggcgaagcgcaatccggagcgctgacgatcatcagaagggtcaggcggcgctaccgcctgctcaaccgcttttcggtaaaaattttcatcattcattatttttgggaacatttagaaacaattttcccaaattatagaaacagagcgcatggagggagtatgaaatttcgggtgagtgtttttcagggctcacccgatagcactacgccgcttttttcaggcaggcgctcataaacttgctacggtcatcgcctttcagtgattgttccgtcgcctgaacattgcattcacgcattttctgctgttgcggcgtcaggcttttctcgccaggggctgactggctgtttttcaggcagtcgctaaggtaggttttacgcgcatcgcctttcaacgcttgcgctgtcgcctgctgattacaggtcgtcatgcgctgctgttgcggcgttaacggtttctcggttgcgccgacggcggttaaaaagaccaggccaaaaagtaaagtcaccagtaatgttattttcatagcaccatccttttgtcagtgtacacattacacgttgtccctttgggaaatatcccagggactttatataagtctggctgttactggcaaaaataccacccggcagtaaaagtattacttaccgttagcaatatatgttttattgattgacaaaccgtaggctaatgtgcaactcgattatccacagtcacactggcaggatgcagaagaacagcgcataacgttacactgttattaccatagccgcttcgtttttattttgctctgtattaaccagaagaaaataaaaacgaagcggctatgttatttcataaaagtaacgttataacaactgtgttgttttaaatacgattagtgccgggggtgtctcagcaacttttttacatattggcgcagcaattccgtatcgtgatcaggaacgctggcatccggctttacgccttcaagtgccccctctacctgacgtatcaacatctcctgctcgttttgcgccatgttacgtaacattgctgtgacgataatctctaacgcttctacctgagcaaccagttctttcgactcttcttctttttgggctagcttaagcaacaactctgctatgagatttttcatgaccatatttccttattagttccagggtgacgttatcactatgaagaaccactgcctagaggctgaaagtactatttttatgatacaggaagaactttacacaaataattatcactgtcgccgcagcgaaacgtttctcagaccgaaaacgagacgataataaaccatcaaaaaacaataatcacgctatatcataatttaaggttatgccatctatagaaaaacttcacggataaagagtatatcttttaatttaaaccatatcgtaacggcagaagcgccgttacgatgcaccgctattggcctttcgctttttgcgcgttacgccgatgacgtaacgccagggtcagttgtccaatattgatcaacacgatcgccgccgtagcgataaaaacccagcggaaaccggccatcgccgataccgtcgcgcccatcaacggcccaaccacgttgcccaggtacataaatgactggttgtagccaaaaatacgtccggtaatttgatcgctggagtatttcaccaataacgtttgtacggcgggtaacatcgcgccatcggcaaagcctaacaagaaacgtaacagccccagctggaacggcgtggtgacccaggacatcgcgaagaaaagcagcactgcgcagataagcgtggccatcagaattctttccgtgccgattctgtcgccaagttttcccaggcgaggcgcggagataccgggcaccgaggcgattaacccgctaagaaaggcgatgttattactgtccggcatcattgatttgataaacagcgccaggattggactgatggaaccattacagagttgaatgaccatcgtggtaaaaaacaaactgatcaccagcgcaggataaggtaacgacgcaaaaacggctttaccgctcaggcgttcgcttttcttgatgaccggacgcacgccttctttaattaaaaatagcgtgaccagaaagctcaccaccaacagcatggcggtaatcagaaataccgcccgcagcccgatatgatccgcgacaaagccgcccattaacggcccgccgataacgccgctgatctgcgcggtagaaagcgtactgagcgcccagccgctacgttcgcgcggtacctgagaggctaccagcgccatggcattggggatatagcctgacgttaaccccatgattccgcgcagcaggaaaagttgccagacatgggtcgcgaatgcttgcagtagaatagctatcgccatcccgagcgacgcgcgcaatagcatcagtttacgccctttacgatcggcgagactgccccacatcggcgatacaatggcggaaataagaaacgtgatgctaaacgttaacccggaccacattgataacgcttcatgggaagagacgccaagctgggaaatatacaggggtaaaaatggcaggatttggctgattgccagcccggtaaaaaaacatccaaaccaaacggaaattagattaactttccaggattccataagactcgtaacggtaagtagctgaaaatacgcgttagcttagcaagctctcattttcctggtggttccagaggtgcgatacgtcacactttgctattttgtctccccgttcatcatttttgtgaaacatatcacattatatagccgcgaaaggcagacgtttatgctttaacgacacacgccgtagccccgcattccaagatgaaaatggttagcatgagcagcgttatagtcaggcccgagcccattgccataataatggcaactggcgtttaacatagcgcgtaaccagggccccgtctcctcacgcccccagccgcgcaggacagtgatttttcggccatctgatagttgaaacccgctgacatccagcgcttctgcgctggcatgttcactgcgacgcgcatccggacggtgataaatattacggcaggcatagctgcccagatgttcgatgcgggtcaggcggcgctgcatccacgtttctgttaaaggttttgcctgctgttcgacaaacagcgcggaacgcagcgccaacgggcaggaggctaaaaaactgctgctcagttttacctggccaaaatctctgacgcgcacaacatgggacaagggacattcaccagcgctatccgcaacaggttgtgatgaaattaatccctgttgattggccgccgtcaacagctcccggcactgcgacggcgtcaggcgctgtagtttgaaggtagtgatccagcctggcggatcggcaagttgtagcggagcaaaaggattataataagagggaagataacgatatcccagcccgccaataccgcccaacagcacaataatcagaaaacccttacctctcacgcggcctccgttctcacatcccataaacattatggcagaagcccgcgaaacccgcgttttgtcgtggtaatgtatacgctttgcattcgatggaatgggtttttaagatggcgaaattgcgggtaggaatagtatttggcggtaagtcggcggaacatgaagtgtctttgcaatcagcgaaaaatatcgttgatgcgatcgataaaacccgcttcgacgtggtgctgttagggatagataaggcgggacaatggcatgttaacgatgcggaaaattatttgcagaatgcagacgatccggcacatatcgcgctacgtccttcggcaatcagtctggcccaggtgcctggcaaacaccaacaccaattgattaacgctcagaacgggcagccgctaccgacggtagatgttatttttcctatcgtccacggtacgctgggcgaagacggctcattgcaggggatgctgcgcgtcgcaaacttaccgtttgtcggttcagacgtgctgagctccgcagcctgcatggataaagacgtcgccaaacgactgctacgcgatgcaggactgaatatcgccccgtttattacactcacccgaacgaatcgtcacgcgtttagttttgccgaggttgaatcccgtctgggactgccgctgttcgttaagcccgccaatcagggctcttcggtcggcgtcagtaaagtcgctaacgaagcgcaatatcagcaggcggtcgcgctggctttcgaattcgatcataaagtggtggtggagcaagggatcaaagggcgcgagatcgaatgcgccgtattaggtaacgataacccacaggccagtacctgcggcgaaatcgtactgaacagcgaattttacgcctacgatactaagtatattgatgataatggcgcgcaagttgtcgtgcctgcgcagatcccttccgaggtgaatgacaagatccgcgcgatcgcgatccaggcttatcagacgctggggtgcgcgggtatggcgcgtgtcgatgtcttcttaacggcagacaatgaggtcgtgattaacgagattaatacgctgccaggttttaccaatatcagtatgtatccaaaactctggcaggcgagcggattgggctataccgatttgatcagccgcctgattgagctggcgctggaacgccatacggcgaataacgccttaaaaaccacgatgtaatagcgcacgcccgatagcgcaacgtttatcgggcgtcttttacctcatcatcttcgcgccggcgaatgatgaaccccgccagccagaagctgataatccacgttaccagcccaacgccataggtttgccatcctttcgcctcaaaacccagcaatcctacgacgccattcaaaataaagataaggccaatagagaaggcatagtagtgccagtcacgacgaatttttacaggcaaacgcataacgactccgacgtattaacagcaacaaaaacgtatttttgcatacttctggcgagcgagtctgtgggggatacggaatttcttaaatgttaattgattttgataaaagtgatcgttttgtgacaactaacaaaaatttacgcgatggatacattccatatgtgaaattaccatgattctgatattgacaaacacaatgacctgtcagacttcacagtaagccgatggcataacgccagatcgtagccgatcatcctggaggtctttatggctgatttcactctctcaaaatcgctgttcagcgggaagcatcgagaaacctcctctacgcccggaaatattgcttacgccatatttgtactgttttgcttctgggccggagcgcaactcttaaacctgctggttcatgcgccgggtatctatgagcatctgatgcaggtacaggatacaggtcgaccacgggtagagattgggctgggcgtcgggacgatttttggcctggtgcccttcctcacgggctgcctcatttttgccgttatcgccgcgtttttacgctggcgtcaccgtcaccaataaaccttagcgcgctggagaaaatatcccagcgcgaaatttatcgccccatacaccgcgcccgccgctcatcaactcgtttagcaaaccaggcggtcgtcagcttacgcgtgatcttcggactttccagttgaataccgggcaacatttcccgcgcaagcgtcttgcccgttttggcctcggccagcttatagactttcttgtagagcgccgttttttcaaacgccaggttatcgcctttctccagttggctgcgaatttcacgctcactcattcccaactgccctgccagtttgcgcaccgctaactctgttttgcccggttccttgctgttataacgaatcagatcgccatccagcgccagttttaccccactggctttactgacggcattctggaacgcagcgttacggctggcgtaccatcccgcgttgaagtcggcgaagcggaaaacaggcgcgctgtagttcgccgggtaattcagcaaatggtaggttccaaaccacaatccgccacggcgcgtaaagacctcctgacgtaccgtacccgccatattccacggataacctttcgcgtgctgttcggcaaaggcaatgctgacctgcatcgggccgcccgtatgcaccgggttatatgagccaaatagcgtctgccccatagggaccatattgataaagtcgtcaaaaatagcgctaagctgtttttcggtttttaccgtgtccaggcgttcgctatagctcttgccgttgggggagttaattttcagcgcggtgtgcaccagaaacagcggaatgtgtagtcgttcagcgcggcgatcaatctcctgccaggcgattttacttagccccggcacgacaggatccgcctgataaccggactcctgctgggcgacagccagcaccgaacagatattttctaccgtcggcgccagcccctggctcttaaacgttgtcgcgatatctttcgcccaggcctctctgtctttgacactggccggcattttctgacgtactacgcttgccacgtcgacaggcttctcgcccttgctcaccggctgcccggattgactactacagccagccaatatggcgaccgccagaaaaggcagaggataaagacgggacgccgccgacataacgtttccttctgttagctaaaagagtgggtcacttcctgaactggctgaccatccaactggcgttcaaagctacgtaaacgtttataaatagacatcagctccaccagagtcgtccaggagttaatcaaatactggaacgaaccgcgcacctgaccaaacacgttggtgatttgcgtcatcagccccagcgtaatcgtaccggcaacaatggaaggaaacagcaggaacaaaccgaaaacgttatcgacctgcaaatagagaatgcgcgcgatgttgaaatacatatagtgaaagtagagacggaagtagttatggcgcaccgcgctaaacagttcacggacggtgggcggcgtggcgcggctggcgtcatcttcaccgtagaccagctctttacgataagctgcctccactcgctgatttttaaattccagccccgacaatttgatcccgacgaccgccagcaggcccgtccccattaatgaccagactatggcggcaatgaccaggccgtaagggatatgtcctacgatgggtaaattcggcacatgcgctgacagggtgaccaacaccggcagaaaggcgataagcgtcatgatggcattgataaaactcacgcccatgttctccagtgtagaggcaaaacgcatggtatcttcctgcacacgctgggcggccccttcgatatggcgcaggtactgccagtgcgccatatagtgctcattcattgcggtacgccagcgaaatacatagtggctgacaaagaagttgttcagcacgccgatcaccacggcgataagcgcaataccgagaaacacccccacttcatgataaaattgaccaagagtgaccttgtgcggcgagttgagcgccgtttgaatcaaatcatagaatggcgcgtaccaggcgttaaccgcgacgccaacctccaccaaaaaccaggtgacaaaaataatgagcgaggtgccaagtatcgaccagtactgccagcggtgcgggctatagatgaaccagaacgttgcaaataatcccacgcaaatcaggtaataagcataaaaaatcagatagtccagcaaccagaagcgcgctgcgctgataggcacttcatcggatgcccctacaagtcgcgccacccaatctcctcctcccgcctgccagaaaatgacagcgatcagcgcccaaacaaacgccgacatgaaaaacggccctggctttgggaaaaaagatttaaacatcatgctctcctgctaacttcttatctttattacggctgctgtgacggcggcaatagcacgccatgcccacggctaaaccaggcattgtgacctacgttgtgacgcttagttcgcatttctgctcaacagaattgtttcgacgagtttcatactcagcaggcacgctgacgctatcaggttatcacaagcgctttatcacaaaagtaaacattctccatcacgaaaacccgccgttacgttttttcacccacttttttctctttaacgttttgcaatgtgccgccgggtagtataaatacgcataaccaccgttatttcacttatggacatcaccgttgaaacgtagtctgctttttactgccatgctgtttgcggcatcacttacttctgtccaggcggctcagccgattgccgatccggtttttgcctctgatatcgttgatcgttatgccgagcatatcttttatggtagcggcgccacgggcatggcgctggtggtgatcgacggcaatcaacgcgtgtttcgtagtttcggtgacaccagaccgggcaataatgttcgtccacagcttgactcggtcattcgtatcgcttctctcaccaagctcatgaccagtgaaatgttggtaaaattgctcgatcagggaacggtaaaattaaacgatccgctcagcaaatatgcgcctcccggcgcgcatgtcccgacgtatcaaggcacgccgattacgttggtcaacttagcgacccacaccagcgcgcttccgcgagaacagcccggcggcgcggcgcatcgtccggtatttgtctggccaacccgcgaacaacgctggaactggctctccacagcaacgttaaaagtcgcgcccggttcacaggcggcctattccaatctggcgttcgacctgttagccgacgcgctggcgaccgcctccggcaaaccttatacgcaactgtttgaagaaaagattacccgcccgctgggaatgaaagacaccacgtttaccccctctcccgatcagtgtaagcgtctgatggtggcagagaaaggcgcaagcccctgtaataatacgctggctgccattggcagcggcggagtctattctacgccaggagatatgatgcgctggatgcaacagtatctgtcgtcagatttctatcaccgtagccatcaggccgatcgtatgcaaacgttgatttatcagcgcgcacagttaaagaaaatcatcgggatggacgtaccgggtaaagccgacgcgctcggtctgggctgggtctatatggcgccaaaagacggacgtcctggcattatccagaaaacgggaggcggcggcggttttattacctatatggcgatgatcccacaatataatattggcgcttttgtggtcgtaacccgttcccccctcacccgttttaccaatatgagcgacgggattaacgatttggttactgagctaagcggcaataaaccgattgctattcctgcatcctgagtcgtcgcgcctcgcgctatatcagacgaggcgcgacatttttgttaatattcggagggcaaacggttaatactgatcaatttgcctttattcatttcaatgtaattacccttacgcagggccgcgagaacttccgccaccaccgatcgcgatacgcgcgttcgttgatgtatataattcataacaccaatacgtgagcgaagttcttcatcccactcaatcattgtcattaacgtcgcacgaatctggtcgtaagaattattaccaatgagctgcttgtcacgaagctccagtacctgacttttccatactatccaacagaaggcttcacgccacagttggttctgctcaatgatggcgagagtttgtgatgatgagaggcgataaccgatgcaaccgctctccgcaattaatttatattgtgcctcttttttcgccacgccatcggctaagccaaaaataaaaggggcctgcacaataccaataagaactttatcaccccgaactaacgaaacaaccccctctaaaataacaaaggtatgggtattactttcatcaggtgaacagataatctctttatcgttaacaaactcgaaacgcgtaccatgcttagaaaggcatttatcgagtctgttgaattcctgtagtggcttgtttaaagataacatatgcattccttgcaataatgcccgtcaagtccttgacgggcatttttcagtttaaattacttttatttctcctgagagaaaatgattaccaggtatatttaacaccaacgtttgcagaccagtcttgatcaacatcaccgccgccgaggtagttagcatcggtgtaggcgctgaagttcttcgtgaagctgaactgagtacccagaccaacacgtaccgcaaaaccttctacgccgttgtcgatagagtcgccgtttacgtcagcatcgttgttggagtcgtcgtaaacgtaagccagtttgaagtacggggtcagcgcctgatcttcgctgtaagtgaaggtataacctgcatctacaccgagttcataacgcatgctgtcgtaagactgaccgtcaactttcatgtcgttgctcagctggtagtcgtcgccggactggaacagaccggatacgctgccgtaaggcgttacgtagcctgcatcacccagcttcagatcataacccagtttcaagccgaagccccaggcgtcagaagaggtgttgccgtcaacgtaagtaccgtcgctcatgttagcagacaaatcgttgttgaagtgagagtagcttaagttaccgtcaacaaagatgttgtttgcgaaacgagcggaagagtagatgtaggcagactggctgtcctgatccacctgaccggtacgatcgctcagatcgcctttcgcgaagcctgctgccgcaccaacgatccacttagcgttgttaccgtcaactttggtatcaacaccgaccatgatgccattaacatcctgatcgtagttaatggtgccgttgtcgccgttgaagttaccgccgaagtagcttacccatgcgccgccgttatccgccaggccatgacgagcgttggtcagacgagtaccaacggtgtcttgttccaggttccagatattggtgttcgcagaaggaatgctcagcgccatgttagcgtagtcggtcagttccatctgttccagcacgacagtgttgccttcctgcttagcctgataggtgtaagcacccaggtcagctttgtttgctgcagagaaggtagcgtcggtgtttatgtcattgacataaatcagctcgttacctttgtaatccgcaacagaaccggcaccagtagcgttgtcgatgcgcactttataattaccagtggccgctacaacgttgtcagtggtgctacttgcatcagcctcgtcaccattgttgatatcgccgttaccgttgatagtcagatgaccatcagagttcatcgcgacaacgccgtaaccgtagttagcctgagtggtatcccaggtacggtcgttcaccaaatcggcatttagggtatagtcattgctatgaatgttgaacacaccagcataaacattgccattattatccgcaacgttactgctagtcagttctaacgtatcagtatcaatgacgctatctgcgtttgtattgttggtttgaatatctaacataccaccgtgagttacggtaatagtattagcatacagtgcatcatcactccatgcactgctgacatcatcagccaaagtaactgtactgaaagtatcaacggtcaggtgatcagtatcaacgtagccaccttccccgatgttcatagctgaaccaccgtttagagtaatggtatcagcggttaaattggagccattagcgacatcaacctgagagccgctatttactgctaaggtatctattacagatgtttttgtggtatcccactcagatccattattcaagctgacgtcaaagataccgctctggaaggaagcagcactattaacacgtccccaggcatcataattagtcgagtctggatctaagctattggcatcaacatcatagaattgcactggatccattgactgtgaatcattaaccgccgcaccaacccatttagtgttattcagggtcaatgtcaggtgatcaacgttttgatcatcatctgcccaaccaccattcgtatagacagtagtggaatcatcgactaaacggccattagaatagaaattataattccaggagctctcaaggacgacatcccccagtaactgcgagtcggtaaacgtaacgttgtttaccatacggtaatttgaataaggatcgtcaacaaaagctaaagcaacatcatctttattccaaccattgccattataatcgcttggttcacttgaattgccaaaatggccttgttcctcatcttcggaccaggagcctgaagttacagttgaattcgctacgttaatagtgttatcccactgatgtgcttcggttgtatatgttgaattgccaagatcattttggtaaagagcaataccagccacatgagaattgttagtaatattaatattactttcaacatcaagggttatagcagtgcctaaaccagcagtaaccaatttgtcataatcggttttgactgtttttccatcagaatcgagataggtatcagtgaagtaaaacgcctcaaagtcatcatcgattgtagaattagaaatgtttagattaaaagtatcatcatcaacccaatcatgggtcgtataatcactaccgttagtccaaacatattgaccgtagcccatctggtaagaagtaatcataccatgaatggttgagttggtaacatccaatgtattcgcagtatcattggcgtaatcatgattcagataataagttgaaataacgccatttacagtgtcaccagtaaattttgtatcaaaatagccgctatcactagctggggtgttgtagacataaccaccataagttagatagtcatggtcgttggtatcatcccagccaaaaacagtggccgcatcgtcatggtacccaaaagtatcgtatgtagtagcattcgcctgagaagtgattgccagagtgcaagccaatgctaattgtgagactacaagtttctttttccaggagtgcatttgtcatccctcctcagggacgtaatatagttgatccatcaattatcaatgcataaaaacatatagatgtttagcaaggaggattatgcggcgtcattgctaaaaggttcaattattctttatcctcagtccggattcggacatgaattaaaaaggcgtaataaaaggaaagttgataattaaaaagcgttctttttcatgaccttgcaagaaaataaaaaaacaaaatacatataagataaatatgaattaaagaaaaacaaaataaatatgaataatgtcaaaatccacatttacttaaatgacgatgaaataaaactaaaaacaacgtaaaactaattcttatttaaaatgatatagtgcctgatgtattaatcttcggtatataaaagaagcgccatgttctgccgccgccggggctgcgcctgctacgttaaggaccgttttcgtaaaacatctgcctgcagattcaggtatactgggccttcgattccacaaacatcaggcagaccatgacagaccttatccatcgccctcgccgcctgcgcaaatccgctgcgctgcgcgctatgtttgaagagacaacacttagcctgaacgacctggtgttgccgatctttgttgaagaagaactcgacgattacaaagctattgatgccatgcccggcgtaatgcgtatcccggaaaagcagctggcgcgagagattgaacgtatcgcaaatgctggcattcgttccgttatgaccttcggcatttctcaccatactgatgacaccggcagcgatacctggaaagaagacggcctggtggcaagaatgtcccgcatctgtaagcaaaccgtgccggagatgatcgtcatgtccgacacctgcttctgcgaatacacctcgcacggccactgcggcgtgttgtgcgaacacggtgtggataacgatgcgacgctggccaacctcggcaagcaggccgttatcgcggcggcggctggagcagattttattgcgccctccgcggcaatggatggacaagtccaggctatccgccaagcgctggatgccgccggttttaccgatacggcaataatgtcctactccaccaagttcgcctcttctttctacggccccttccgtgaagcagcgggtaccgcgttaaaaggcgaccgcaagacgtatcaaatgaatccgatgaaccgccgtgaagcgattcgcgaatcactgctcgacgaagcccagggcgcggattgcttaatggtgaaaccggccggcgcgtatctggacgtgctgcgtgaaattcgcgaacgcacagagttgccgcttggcgcttaccaggtgagcggtgaatacgccatgattaaatttgctgctatggctggcgccatcgatgaagaaaaggtcgtgctggaaagtctgggctcgattaaacgcgccggcgccgatttgattttcagctacttcgcactggatctggctgagaaaaatattctgcgttaattctgttacagggcggcgcgctgccgccctttcccgactttacaccccactattcagtcgctgagtctaacccgttgccggacgcggcttatccggcttacggctattcctcgatcgcctggcgaatttgctgcaacgacgcgggatcgtcaatggttgtcagatcgcccggatcacggccttcgcagatcgcctggatcgtgcggcgaagcatctttccggaacgcgttttggggagctgcgaaacaaaccagacatgcgccggacgaccaaagtgaccgatctggttatccaccagcgccataatcgctttttcctcgtcgcgcgccgcctcgcgatccgccagcgtatcgctctgcttcggaatgacaaacgccaccgccacctgccctttcagagcgtcttttatccccaccaccgccacttccgctacgttcgggtaaccggagatactttcttctatttctcgcgtccccagccgatgacccgcaatattaatcacatcatcggtacggcccagaataaagtaatacccctcggcgtcgcggattccccagtcgaaagtggcataaacctgacggttaaacagcgaccagtaagtcttcacaaaacgcgcatcgtcgccccaaatagtctgaatacaacccggcggcagcggcccttcgatcaccagcatgcctttttcatttatgccgcagggttcgccggtgacttcattgagtagctggacgttataaccgtacatcggcaccccgggacttcccagacgcgacggcctgtcgtccagcgcgcgggccagcgccatgatcggccagccggactccgtctgccaataattgtcgatgaccggtacgcccagcgtctccgtcacccaactggccgtcggctcgtccagcggctcaccggccagataaagcgcctccagcgaggagagatcgtgattgcggatttgcgccgtcgggaattttttcagcacgcgaatcgcggtcggggcggaaaacatccggttaacctggtatttctcgacaattttccaccagaccccgcagtccgggtacgtcggcagtccttcgtaaacaatagtcgccatgcctgccagcagcggcgcgtaaacgatataggagtggccgacgacccagccgatatccgatgcgcaaaagaatacgccgcccgccttgccgccaaaaatggtgtccatcgaggttgccagcgccaccgcataaccgccgacgtcgcgctggacgcctttcggtttgccggtagtgccggaggtgtaaagaatgcacgaggtttcattggattccagccacgccaccggcacgctcgcgccgagatactgctggcgcaacgtggaaaaatccagatcgcgcccatccacccacgacattttcgccagccctctgtccaccagcagaacgtgtttcggctgatgctgcgcctgcgcaatagcgtcatcaagcagctttttatacggcagaattttaccgccacgcgctccggcatccgccgacacaatcagcgccggtctggcatcgtcaatgcgcgccgccacgctgtgcgaggcaaaaccgccaaagaccaccgaatggatcgcgccaatgcgcgcacaggccagcagggttatctgcgcttcggcaatcatcggcatatagaccaatacgcgatcgccacgctgcacgcccagcgacagcagcatagcggccacagcgttgacttcatcatgcaactggctgaaggtaaatgtgcgctcttcatcggtctctgatgagacggcaatcagcgccagcgcctccggctgtttatcccgccagcggtcgacggcgttatgacataagttagtggtgccgccgcaaaaccagcgggcaaacggtggacggctatgatccagcgtctgcgtaaacggctgtcgccagtcgatacgccgggcctgctcggcccagaacgcctccggttcgttaatggaacgctgataaaattcgctaaaagacatcacgctctcctgttgaacttacgccttactgctggctggctcagatgatatataaatcgaggtattcgttaaccggcatctgctccaggcgggctctgtccagggagacatccagaatgcgttgctgctggcgagtcgggaactgacgcgccaggttaattttaaatttttcgataagcttcggaataccgtcggcgcggcgacgcgcatgaccaatcggatactccacgacaacctcgccaaagcgtgagccatcagtaaactccacggtgatcgcattgccgatagcacgtttttccgggtcgtgatagtcggcggtaaaagccgggtcctcatagcacacgattttctcgcgcagggcgtcaatacgcttgtcctgcgccacctcgtcttcataatccgccgcggttaaccgtccgaacagcaacggcacggcgaccatatactggatacagtgatcgcggtccgccgggttattgagcgggccttttttatcgataatgcgaagacaggcttcgtgggtgcggatagtcactttctcgatatccgctgccgttttgcccgcggcctgcatctgctcatacagtgtcatcgccgcttcgacggcggtttgcgagtggaattctgccgggaaagaaattttaaatagcacgttttccatcacgtaggagccgtaagggcgctggaaacggaacgtttcacctttgaatgaaacgtcgtagaagccccaggttttggcggtgagcgccgagggatagcccatctcgccggttttcgccatcagcgccagacgtaccgcgcgcgaagtcgcatcgcccgccgcccaggatttgcgcgtaccggtattcggcgcatgacgataagtgcgcaacgactgcccatccacccacgccagcgataccgcgttgaggatctcatcgcgcgtcagccccagcatttcagcgaccaccgcggtcgaggccactttgaccagcagcacatggtcaagcccgacacggttgaaggcgttttccagcgcgatgcagccctgaatttcatgggctttgatcatcccgctcaatacctgtttcatggtcagcggcgctttgccggcggcgacggcgttgcgtgacagccagtcagccgtcgccagaataccgccgaggttatcagaaggatggccccactcggcggcaagccaggtatcgttaaaatcgagccagcggatcatcgcgctaatgttaaaggctgcctgtaccggatcgagctggaactgggtgcccggcacgcgtgcgccgttgggcaccaccgtgcctggcacgattggcccaagcaattttttacaggccgggtattccagcgcttccagaccacagccgagcgtgtcgagcaggcagtaatgcgcagtgtcgtacgccacctttgaggtgatctcgtaattcataacgtaatcaacgatatcaacgatttcacggtcaaagtctgggcgaacgttcgaaatatgtgcggacatagggtacaactcctgtttttatatttagaggttttaattagcaacgcttttcgatcggcacaaatacgcgatcttccgggccggtataattggcggaaggacgaataattttgttgtcctgacgctgttcaataatgtgcgccgcccagccggtaacgcgggcgatgacaaacagcggggtgaacatttcggtagggacgcccatcatgttgtaggagaccgccgaaaaccagtcgagattcgggaacatctttttggtctcccacatcaccgtttccagacggtcggcgatgtggtacatcttcagcgagccgccttcttctgaaagctgtttcgccacccgtttgatcacctggtggcgcgggtcggcgatggtgtaaaccggatgtccaaagccaatcaccacctctttgttttccacgcgtttacggatatccgcctctgcctcgtccggtgtttcataacgctgttgaatttccagcgacacctcattcgctccgccgtgtttcgggccgcgcagcgcgccaatcgcgccgataatcgcggagtagacatccgagccggtcccggcaattacccggctggtaaacgtcgaggcgttgaactcatgctcggcgtacagcaccagcgaaatatgcatcgccttttcccagctttgggttggcttttcaccgtgcagcagatgcaggaaatggccgccgatggaatcatcgtcggtttccggctgaatacgttcgccgttgtggctgtagtgataccagtaaagaaggatagagctgagcgaagccaacagcttatcggcaatatcgcgcgcgccggagacggtatgtccctctttttccggcagggtgcagcccagcgcggaaacgccggtacgcatcacgtccatcgggtgcgaggccgccggtaacgcttccagaacggtacggacattggcgggtaatccgcgcagcgcttttaacttgcttttatacgcgttcagctcgtcgcgggtcggtaattttccgtggatcagtaaatgcgcgacttcttcaaattcgcagtgctccgccagatcgagaatgtcgtaaccgcgatagtgcagatcgttaccgctttttcccacggtacacagagcggtatttccggcaggtacgccggaaagcgcgaccgattttttaggcttaatgacatgcgtgttgttttgcaggatcgtcgtgtctgtcatattgtcctcgtcattattgtaatgtgtagggtattgaggcgtgtaggccgtaccgtaggcgggataaacgtagtgccatccggcattgcctgatggcggcttcgccttatcaggcccacaggctacgattttttattcctgtacagcgcgtccagcttctcttcgaactggtagtaattgatgctttcgtacagctcgttgcgggtctgcatgatgtcgatcacgttcttttgcgtcccttcctggcgcagcacggtatagactttttctgcggcgcggttcatggcgcgaaacgccgacagcggatagagcgccatcgccacgtgtgcgctgcgcaactcgtcggtcgtaaacagcggcgtcgcgccaaactcagtgatgttggcgaggatcggcacctgcgccacgtcggcgaactggcggtacatcgacagttcggtgatcgcctccgggaacagcatgtcagcccccgcatccacgtaagcctgcgcgcgatcgagagccgcctccagcccttccaccgccagcgcatcggtacgcgccatgatcacaaagttcggatcggtgcgcgcatccactgccgcccgaattctgtctaccatctcctctttcgagacgatcgctttgtttggacggtgtccacagcgcttagcgccaacctggtcttcaatatgcagcgcggcggcgcccgctttggctatggactttaccgtccgcgcgacattaaaggcggaggagccaaagccaatatccgcatccaccaacagcggcagcgggcaaacatccgtgatgcgccggatatcggttaacacatcatccagcgtcgaaatccccagatccggcagtccgagcgagcccgccgctacgccgccgccagaaagatagatagcctgatacccggcccgttgggccaacagagcatggttggcattaatagcgccgacaatttgtaatggattctctttagcgagcgcggcgcgaaatgcctgccccggcgaatgtaaagacataattcgtcctcatgttagtaaattgttattcaagatgtattcaccaaagcaaaggctatgccaggcaaagaggcagcgagaaaattaaatacaatgagatttaaaaacaggtaattacagtcattcctgttatgaataagcgcgattaagggaaaagaaaaacgtgtcagctaacgtttcatgaaacgaatcgctccgtttcattgcaacatttatgaaacacgtttaaaacaaaaaatcgccccttaaagatgaacctactgcgatgacgactgctcacagcgctccgcgcgataatagcgataaaccggtgatctggacggtctccgtaacgcgtctattcgaactgtttcgggatatcagcctggaattcgatcatctggcgaccatcacgcctattcaactcggctttgaaaaggcggtgacctacattcgcaaaaaactggcgaccgagcgctgcgacgcgattatcgcggcgggttcgaacggggcctatttaaaaagtcgcctgtcaataccggtgatcctcatcaagcccagcggattcgacgtattacaggcgctggcgaaagcgggaaagctcacctcgtctatcggtatcgtgacctatcaggagaccattccgactttacttgcctttcagaaaacgtttcacctctgtcttgaacagcgaagctatgtcaccgaagaggacgcgcgcgggcaaattaacgaacttaaggccaacggtattgaggccgtcgtcggcgcgggattaattaccgatctggcggaagaagcgggtatgaccgccatctttatttattccgcggcgaccgttcgtcaggcttttcatgatgcgctggatatgacccgtctgacacggcgccagcgcgtggattacccatccggcaagggattacaaacccggtatgaactgggcgatatacgcggccagtcgccgcaaatggagcagctccgccagacgattacgctctatgcccgctcccgtgcggcagtgctgattcagggggaaacagggaccggaaaagagctggcggcgcaggcgattcaccagacgttttttcaccgccagcctcaccgtcagaataagccatcccctccctttgtcgccgtcaattgcggcgcgattaccgagtcattgctggaggcggaactgtttggttatgaagagggcgcgtttaccggttcacgacgaggaggccgggcggggctgtttgaaatcgcacacggcggcacgctgtttctggatgaaatcggcgaaatgcccttgccgttacaaacccgactcttgcgcgtactggaggaaaaagccgtcactcgcgtcggcggacaccaaccgatcccggtggatgtccgggtgatcagcgctacgcattgcgatctggatcgggagataatgcaaggacgttttcgccccgatctcttttatcgcctgagtattctgcgtctgacgcttcctcctttgcgcgagcggcaggctgatattttgccgctggcggaaagctttttaaaacagtcgctggcggcgatggaaattccgtttaccgaatcgatacgtcatggattgacacagtgtcagccgcttttgctggcctggggctggcccggtaatattcgcgaactgcgtaatatgatggagcgcctggcgctttttttaagcgtcgatcccgcaccaacgctggacaggcaatttatgcggcagttattacctgagcttatggtgaacacagcagagctgacgccttcaaccgtggatgcgcacacgttacaggatgtactggcgcgctttaagggcgataagaccgcggcggcgcgttatctggggattagccgcaccactctgtggcgtcgtttaaaagcaggtgccaaagaccagtcgggtaattaagacaaatgacagcgtcctgaatgcctgatggcgctacgtttactgcaggccgtcatccggcaaaacggatgccggttgccaggaataaaaatacccgccggaaacccaggcgggtatttttatgatgcaacgcttttatttctttttataaatatcagccgtaccatgaattttattttctgtctgcccggacgtcagcaccaccacatccgcccctttttcatccgcctttttgattaaatcttctctggcgtccagcggcgacatttccccggtggtggaaatcgtgccaattttcgtgtattcggaggcgactttatcaaagtccgtttttttcatgatttctgcggcataaacgtttgtcacgacaaacgctaatgcgccaagcataaccttgtagccagttttcatagcaaaaccctcgttttattattacgccatcatcgctttatcagaacaaaaaggccgttcggactgattaaataagtagtgtagattgctggaaaaatccagtcagcccccgctcactcggcataacgacgcggattaaaacgcccctgctttgtgatctcactcgcaatcatctggtttgactattaataagatgaacgttatttcttgaggctatgggaagagttgtctatggagccgtttcatgccgttgtgcttaccgtcagtctgtttgtgttaaccttttttaatcccggcgcgaatctgtttgtggtggtgcaaaccagcctcgcatcaggacgccgggcgggagtcatcaccggcctgggcgtcgccacgggagacgccttttattccgggctggggcttttcggtctggcgacgctcattacgcaatgcgaagcggtattttctcttatcaaaattgtcggcggcgcctatttattatggttcgcctggaacagtattcgccaccaggcgacgccgcaaatgagcacgctccagacgccgattgccgccccgtggacaattttctttcgccggggattaatgaccgatttatccaatccgcaaaccgtactgttttttatcagtattttttccgtaacgcttagcgcagaaacgcccacatgggcaaggttaatggcctgggccggaattgtgctgtcatccgttatctggcgtatttttctcagccaggccttttcgctccccgcagtccgccgcgcttatggacgaatacagcgcattgccagccgtgttatcggcgccattatcgggatgtttgcgctcagacttctctatgaaggcatgacgcaccgctaatgtttgcccggtagcctttgctaccggacgataagcgttatcaaaacgcccatgacacgctgcctacaatgctacgctcggcgccaaaataacaataagagagcgaattacaggcagcgacatagcgtttgtccgtcagattatttacgttgagctgggcgctcaagccatttaacccaatgctggataaatcatacccaaccaccatgtcgaccagtgtataggacggcaacgtgtgggtattcaggcgatcgctggtcacgccgttgacgtaccggatgccggagcccaaagtcagccactctaacagaccgcttttcacatcgtagcttagccaggcgctggcctggttccgtggagcataaaccgcgcgcttcccctgctcttgcgggctacttttcttataacggatatcagtataggtatacgccgcctgcaaacggacgctatccgacaaatggctaatggcctccagttcaacccctttagactcaatttcaccaatcgagcggtacggatcggtaggttcttctttggtcgcgatattggtttggttaatacgatacacggcggcgctaaactggctgttcccccccagcggttcgtattttacccccgcctcccactgcttgcctttcatcggttccagcacattgccgttttcgtcggcgaagctggtcgacgtaaacgcggtagaataactgagatagggggcgacgccattgtcgaacagataaagcaacgcggcacgggtgctgacgttgtttttatcgagatcgctgcgtgaatcatgaagtttgtcgatgttagacacgctgacccgatcgtaacgaccgcccaacgtaaagcgccagcgatcccatgacatctgatcctgtaaatagtatccggtctgccgcagcttatgtttttcacggctatacaacgtaatgtaatccggctgagcgccataaacagggttgaaagcgtcaatcggcggaaacgcgccataatagccagtagtatgattactgcgatcctgataatcgatccccaccagcagacgatgattaatcgccccggtatccacgctgccgtcgagctgattatccagcgcgatagccgacattttctccccggagccggaatagccgcgattcagcgccgtttcattcaaccaacctgcggcatagacctgattcaacgtcactttggtatgcaaataacgcaatttttgccgtaccgaccagccgttatcgaacagatgctcaatgttataacccaccatattttcacggcgatcgtatttgtcgtagtcatcttcaccttcaaagaaagtgttagaaatttttccgccgttataaggtacaaccgtgccttgataaggcagtccggagtggctaccgccttgcggatcacggtgcagataggccataagatcaagacgcgtccgatcggtaattctccaggtcaggctcggcatcagcgcataacgttcctctttcaggggcgtaaactgcgaatcggcgtaacgtgtcatgccgctaagacgcgccgccacacgttcattgtcatccagtgggccggtcacatcaaaagccgccccgcgctggttgttattgccggcaaacagcttcacttctcctccggcatcaaacgccggttttcgcgacgtcaacgagacaatgccgcctggcgatgaacgtccatacagaacggacgccgggccgcgtaccacctcgatatcttccagaaaccaggggtcaaccaccaacgaactgtgcgaattggtgtcgcccatcatttttaacccgtcgagatagacgttatccagactaccgtccgaaaaaccacgcaatacgatgtaatcaaagcggttagaggcgcctatctggttactgtatacgcctggggtgtagctgaccgcctgacgcacgctggttgcgccctgctcttcaaactgctggcgggtaataatggataccgactgcggcgtttcaatatctggcgtcgccagcctggtcgcgccactctgaacgggcgaggtgacaatgacggtatcattttttgtggtttcctgggcaaaaagaggaaaagtcgcgccgccgatagctccgcctatcaatagcgccatacgcgttgtcgcaaacatgaacatctccaaaggcatctttattgtaaataagaattattaccctttagagataacgaaccactatgcgtaacgccagattgcctatgcgcaatgataaaaaatcacccaaagcggcagaaaaccgggttagcggcggatattaccgctctggcggggcgcgttacgcacagtggcgggacgccgtcagagacgcgtcacgcagctcgccgggcgagcagccataacgccgacgaaatgccgtcgcaaagttagtggcatgttgatagcctgacatccaggcggcctgctgcacgctgtatccctccatcagataacgacgcgcgcgcgccaggcggcaatcgcgcagataatcaaacacggtacacccataggcatggcgaaacttgcaccgcaggctactcggactcattgccgcccgacgcgccagttcgttcagcgtgtaggctttttccggcgtttgctccagtaaacgccgaatgagctccagccgctggtattcaccggtgacgggaagtccgcgtttttgcgttgcgggctgacatagatttaacgcatagcccagcaattgcagcatgatgccttccagcattaactggcgtgacgccgcatgaggtccgggctgctgcgcataacgtagccccgaaagcagaaactccggcacctgccagaccctcgccgaggccgcgctacgttcccactcgtctgccagcgagacaggcaaacgctcccgccacccgccgtccgggtacattcccagcgataaggtgcgcaatttactgtctgcgccgtgatgggcgcgtatcgtctgctgctcactcagttgcgagcaaaacgccatccccgcgctcaacaaaaaggtctgctcattgacagccagcgcgacgttaccttccaacaccaccagcatatacagcggactgctatggcgagaggtggtttcataaggttgtaacacgtgaacatccgagcgtgtaatgcaaatcccgccgggaagcgctatctcttcgatatcgccatgaagtacgggactactctgcgtatactgcggtaacgcagggaagcggtaatcaatgccataacgctcgccaaacgcgatgaagtcgctgacggaaaagatctttttcatcgccggggcggcggaagagtgacaggagatcggagacattatcaataccgtttatctgcgttataccagagcgttagccactgtgtaaccatatcactgcggcccgggaacgacaataaagatgagaataattatcaaccgctattgaggggagagataaggcgagcaaaggtgatcgataaacgccgatctgtcgataaaaacgcgctttcgcgagagacgaaagcgcgtccgggggtatcagtcaggagcgaaatcctgcggaggtcatgagcagtctgaacaacattccgacgcccgccagcagaagcacgctggcgcaccatatcgcgaccatccatacgactcgccgcgaccattttttcactttaaccatcagtgatatccctctccatgtcgcacttttccacggaagacgtagtagctccagaaggtataagccagaataatcgggatgattatcagcgccccaaccagcataaagctttgactttgcgacggcgcggcggcggcatacagcgaaatatccggtggaataatattcggccaaatactgattcctaacccgctgaaccccagaaaaatcagccctagcgtgagaataaatggacgcgcatgggattgtggttttttcacgctgcgccatagccagacgctaaaagccaacaccagcacaggcaccggcaggaagtagtataaattgggcagcgtgaaccagcgctcggcgatgtcgtcatgggtgagcggcgtccacacgctgacgccccccatcaccagcaacaagacgatcaacaacgggcgcgacagcgcgcacatccggctatgcagcggatcttcgcttttcataatcagccaggtagcgcccagcagcgcgtaggtgacgaccagaccgacgccgcagaacagattaaacggcgtcagccagtcaagctgcgaaccgctaaaggttcgcccttccacctgaaaaccgctcaccaccgcgctcaccacaaccccctgggcaaaggtcgccaggattgacccgacgataaaggatttatcccagaacgcgcgatgcgactcggtggctttaaaacggaattcaaaagcgacgccgcgaaagataagaccaagcagcataaccaccagcgggatagtcagcgcgtcggtgatgacggcataagccaacgggaacgcgccaaaaagcccggccccgcccagcactagccaggtttcgttcccgtcccataccggcgcgaccgagttcaccataacatcgcgatcgtgtttatcacgaataaacggaaacaggataccgacgcccagatcgaaaccatccatcacgatatacatcagcgtggcgaacacgataatagcaaaccagataaccggaagatcgatggtcattcgcgtttctcctgctcaagcgattctcccacggcagagataggacgcgcgggtctgccatcggtttcagcggtcggtgtctccgccggctgcggccctttctggataagacgaatcatataaatatagccaaccccaaacaccagggaatagaccacaaagaaggccagcaaactgatgctcatttgcaaggtgctgtgcgcggaaaccgcatcacgcgttcgcagcaggccatagaccacccacggctgacgtcctacttcagtcgtcacccatccggcaaggatggcgataagcccggacggccccatccacagcgcaaagtgcataaagggccgcgaatgatacaggcggcgtcggtagcgtagccacaggctggccagccccagaaagatcatcagtacgcccatgcccaccatcagacggaaagaccagaacaccacggtagggttggggcgatcctctttgggataatcttttagcgcaggcacctgtttgtccaggctatgcgtcaggatcagactgcccaacgccgggatctcaagcgcatagcgggtccgttccgcctccatatccggccagcctaccagcgtaagcggcgttggctcgccgggcgtattttcccagtgcccctcaatcgcggcgattttgaccggctgatgcttcagggtgttaaggccatgcatatcgccaatcaatgcctgaacgggtgccaccacgaccgccatccatagcgccatcgagaacatacggcggatagccggcgtatcgttacctttcagtaaatgccaggctgcggacgcgccgacaaacatcgcgctacttaaaaacgccgcaacggacatatgcaacaggcgatacgggaacgacgggttgaaaatcaccgcgaaccagtccaccgggactacctgaccgttatgaatttcaaatccctgcggggtatgcatccagctattagacgccagaatccagaacgtcgacattaacgtgcccaacgccaccatacaggtagacaagaaatgcaggcccggcccgactttgttccagccaaaaagcatcacgcctaagaatcccgcttccaggaagaatgcggtgagcacttcataggttaataaaggcccggtgatactgccggcgaactgggaaaaaccgctccagttcgttccgaactggtaagccatgaccagaccggagaccacgcccatcccgaagttgacggcaaaaattttgagccagaactgatagagcgagcgccagacaggattacgcgtttttagccataaaccttccagtaccaccaggtaactggctaagccaatcgtaatcgcggggaaaataatatgaaaagagacggtaaaggcaaactggagtctcgctaaaaagaatgcatcaaactccatgttccctcccgtttatatagtcacttcgtgtaaaatattcactgttcgcaaccaggttgaaacgaaacggttattttccccaaacgtaaaaacgtcggggaatatccagataaattacgattttttttgcggctggctgtcaggcttatcgcccgactctggcgcttcggaggggtcgtctttttcgacagcgaaacggtagtatctatttagcataacatgtctcccttagttacattcacttggcaatatctacctggccgttataaaaataacggcaaaacaaaaaaacagcgtcttcaagactatttgcaatttcagcaaaatacacttagctgaaagttaagaatagacgtaaaacgataaccttcaagtcaacgcggtttacgggacgggggattagcacaggagaatgaccgcaacgctcgctgcgcggcggccattttatatggcctatcaaaaagataaccgttaaggtctattcaaacccgttagtttgccttccccccaatcaagccattgatggtagaaaataccgccggcgcgctggtcgcttccgcaaactcgacattgatattttgccgacgcagcatatcgaagaatttacgttgcgcatcaagaataacctgatcgcctacgcgcatattttctgctttagtttcaaccagtaaataaacactgtcggcgtcctgacgctcaatacggtacacaaaatccggcgtagtagagccccccgtatatttggggatctgaatggcccgcttaggcagtttgccaaacacagaaacctgttgcggataatcgtattttaatagcggcaattctggatcgacgctgtcataacgcaacggcggtatttgatagagagaacggggatcgtctatcgcattctcatccacatttttccccacaatttcagcgctaatctcctctctgaactgccgtgccgtagaatcaaataccgacgttgaagcctgaaaatcgagaggcagataatcgtggcgctgcgcaaaatgcgcattaatccgcgtctgtaatgcgcgggtcatattgtccaacgagatctcgcttaaatagcgtgaatctccgtgcaaaacatcacgcagcatcgccattaacaccgggtgcaggacgttaatcggcagactggtgcgtaacgccagttgcttaagaaaatggccatatttcatgcccgccataaattcgctggcggctaattcgccttcccgctgcgccacttcaaaacggccattatcttcattcgataccagccgttgttgcacctggcttggcttctggcgtatatacagcgacggatcgcgcagcacctcggcggcaatctgttccagagaagcgccgctacgctcgaattgcagcatataacggcgggaaaactgctcccagatactgctaagttgttcccaattctctttgcgtaacctgactcgcagtcgggaggcgggcttattgtcacgaatgcgatccgctcgcacccgcgcctgcgtcagctcagggtagaactccagtagccacgcaaagccacttttggtttccccgttaagcgtgacgctgggtttaaactcattactccggttgatcagttttttatcatccagatcttccagcaaacgaagctccgtaaacgcaggatcgactttttgtcgctcggtgacgatgagtgtgatcatcgcctcatccagcttctgctcgttaagctgaactttgctgtcgcgattaatctcatcaaccagcatactggcaaacgctttttcatcataaccaatcagaaacgacagtcgggacggccactcttcctgatgaacgcgatggccgttttcatctaccggtagccgcaggccgcgccccacttcctgaattttgctcgactcgctaccggaagaacgtaatttagcaatgacaaaaacattcgggttatcccagccttcgcgaagcgtccattttgaaaacagaaagcggcgcgtttcccagttgccgtgatggtctgaaaaactgagcaacttctctttatttttcagaatatcatctacctcagcctggatcgcctcatcgccgcttccgcggtcttcgccaaagtaaccagcgtggacgttttggttatccgagtgcaggctggcgagcgtggcctgcagaaacgacagatactccacttctcgcggcagggtcttgcgctgataatcgtcaatcagttgcgtcagtttctttttcagtaaacactcaaacttcagtttcaaccaaccttcgtcatcacgatagcttttaatactgtcaataaagaaaaagcttaaggtcttaatacgcggggcattattttctggctcattgctgcgtaagaaatttgcctgctcagtgtcaaaatgcttatcgatagcgtcctgaataatcagttcctggtagctcgcgccaaaggttcctggcaccagcgccatccctgcctccagctccagatcgttcgacaacattttactgccggcatattcgatactgccttcaaatcctgcatcgacatcggcgagattttcgcccacgccaacctcggcaattttgctcccccgtcggaggattaatttctttgccgtgacgctgtcaacgatataacgattgttggcctgttcttcggggagattcgggtaataaatatcaatacctttcaccaaaccatcgttaaaactgtccaccgcgttgagatcaaactgcggttgccggcgatagtaatctttacgtacacatttatttttacccttaccttcgacaatatccgggaaggtagcgccaaagcggacgatcatttgcggctgaatggcctgaatcgctcgataaaatttgttatctcgcacaaaacgatgcggttcatcaataatgaccaccggtcgcgtcatttgcagccctttaacaggcgacgtcagcccgcccagtagcgttgatcgtaatcgtctcgcgtcatactggcggaattgagcatttgcgcattgatcagcaaaacctgaatcgtatggctatcacgacggctggcatcagtaaaacttaataactgggccggaaaatttttacgccccgactttactttaaaatcaccggcgttgatggtgcaaaattccatccgcgtattttcgtagaactgtgaaaaatgctgtctggcgtaatcgctggtgataaagttccgcgcgccttctttaatggctggcgtcggcaccaccagcacaaatttgaagaggccatacttctgatgcagttcatacatcaaccgagtatagacataggttttgcccgtcccggtctccattttaacgtcaatattggccttatcgtcgtaacgtcccttaatcagcggattagcatagtgattatgatcggcctgcgcgtgatcgataccggtgaaactcgccagaatcgccgctaacgcctgttcctgatggggaagttcttccagcaaaatattcatcatcatcccctcttaataacgcttcaccaggttcactttttgatcaagctgttttaagccgatttccagttcacgaatggattcaaggtcgaaagagtagccgtaaatgacaatggtctgaaccggaagctggtgcgtaccaatgtggttgagaagatcgcgggtctgctctgttccccatcgttcatcaatcagatacaggcgcgtattatcaacatacctggcgcaatagccggaaaaatcaacggtctgtacgtcaatatccattttataaccatcggcgaccagccatgtcgttaataaggtctcttcgccgcttgcgccgcccggcacgcccaatcctctggcggaaaaaggattgatcatgtcggtaaatcctgactcggtgaaagcggccagttgaccgctggtattgataaaatggccggtagcaatatcgaagctatccagatcgtccagcgtctgctgtgtcggagtggcaaaacgataatgtttaaaaccgagatcgctattggtcgcgggattgttggcgcggatcttcgccgcaacgcgtgtaattcgctcgcggctgatttcatcaatagtgttataacctgcttttttcgcgatagtgttattgcttaatgcctgatcgatagtacacagaataaacgtgcgctgccccccatcttcttcattcagcgccatcaccgcatgggccgtggtgccggaaccggcaaaaaagtccagaacgacgccgtctttatcgatagcgagcttgatgattttcttcaataatgcggtcggtttcggcgtatcaaaaacgttgtcgccgaagagatccagaatctcctttttcccctctttattcgacgctacgttatcccagtaattggtcgttggctgccctttactgtgatgcgcgtacatgactcgctggggaataccgccgttatctttgccaaaatagaccagattatcggccaccagtttttggtaactggcttcaggataagcccatagtctttcgtgtaccgtaccgttcggcgtggtaattttataggtatagccgccgccgctcagcccttttgacaccgttaacggcaccggtcgccatttcccttctggaaactgttcggtcggttctttataggatttctgaatatactctttagaaagcggttctaaacgtaaagcgccctgaccggttttggcgtaaacaagaatgtattccccctggatggaaacgttatcagagtcgttagaaatctcttttttgcgcttccacatcacattggtgacaaatccgccttcgccaaaaatctcatccatcattaatttaagattggcgtactcattatcgtcgatagagataaaaataaacccggtatctttcaggagcttcctggccaggaaaagacgcggatacatgaaagataaccacgcggagtgcgtcgatttaccctgaatggattttaaacgtgccagttcggtatcattaagaccaaacatatcctgcaacgcccgatcgctatattcaaaatgatcgggatagacaaacccgtccgatccggtgttataagggggatcgatatagatcatatcgacggtatcggcgtaattattttgcagatggcgtaaaacatccagattatctccggtcagaaaaagattatggctgtttttattttctgccagagtattgtgttccacgtcaggaacgataacggtaacggatttttcacccgcctgtttttttgcgtaatctttgccaataaaatcaatctgataaccgctagtcagctcatcaatattacgcgctttcagcgcgcgctcaaatttggcgagatcaaatccgcctttcgcgatcagttcgccctgctcgttatagcgatcggcgataaaaaattccggtaatgcacgttgtaactcagacagaaaggcgctattcggggcaacagactcgttgtgtttttggttatctttcaacatgatatcttcgctccgttgacaattttaaggtccaacaatcaatttcttataaagaaaaaagtaagcgatgattgtaatggtcacgaaaggcagatgccatcattaacctttgttgttcgttgaaagggcgtaaaaaccacaggaggaaggagcgctcccggcgacagtatgcgccaggagcgtagtgtttacgtgcgatgaccgatggccgactccgggagggcgtcgctatctgtaccggagatgacgactccccgggtctcgcgaccaaatgccacaaatacacagattaaaatagccaccgcgccagccacgatcgccattgccaacccgtaattgccaccatgcgtttccgcgatgcgggcctgtaacgtcgcattaaccgacgccagtaaattaccgagttggtaaacaaaccctggcagcacggcgcgcgcattcgccggaaccagctcgttcagccaggtcggcacgacaccccaggcgccctgcaccataaactgcatcaggaacgcgcccagaccaatcgtgaatgatccgctggaaaatgcccatagcgggagtaccggaagcgcaagaaaggcggcgatcatgatcgcttttttacgcccaatacgttccgatagcgtaccgtagaaaataccgccgagcatggcggcaatgttataaaaaattgcaatgatactgatcagatgcggatcaaaaccatgctgcatcttcaggaaggtaggatagagatcctgcgtgccgtgactgaaaaagttaaagaacgccatgaccagcaccagatacagacacaacttccactgtttgcgcagaacaggaagcagcgcggtattctctttacgcgctctggccgccagccagacgggggattccggcactttaaaccagatataaggcagcaagacaacaggcagggcgccaatcaggaacatgccacgccagcctaccatactgtagaagaggccaaaaataaccgaggcgaacagatagccgcagggatagcctgcctgaaaaatgcccgacatcaggccacgcgaacgatcgggaatggtttccatcgccagtgatgacgcgacgccccatatcccgcccatcgccacgccgtacatgacccgaaaaatcagaaatgccatgaaggtgggcgaccaggcggaaagcagttcaaacaccgtaaagaacagaatattgagcatcagtatcggtcgacgtccgtacttttccgccattcggccaaatagcagcgcgccaatgggacgtaccgccagggtcagcataatcgcaatggaaacctccgatacggaagcgtgaaaccattcggcgagatcgctaagtacaaagacaaggataaagaaatcaaacgcatccagcatccaactggtaaagctggcaaacgccacatgtcgttgtgtcgtcgtccagttcaggggggtgtacataggtagtgtcctgcatcaaaaataacatcaagctttgaagcggcgaaacgctggagcgctcccgtcgtcaaagcgacgtaacaaggtagcgttgcgctacttatttgttatctttttgtatatagcaggtaaaatgttagcaaaaatagacaaatcattacatattattaacaaagcttactggcacatgatttgtcacattttttatggggattatctcacgcaaagaaaagcgaagcgtggctagcgtatcgcgaccggcctgtcgccagaccgatcgccattgacgattacctctcgcgcggcgggaaaccggccttttgcagggcggcggcaatctgctccgcggatagcgacgtttcaatgtcaaccagacgcgtcgccgggtcggttctcaccgtcgcattagcatcgagagtcagaatcgtcttttttaccgtactggcgcagccgccgcaggtcatgtcatcaatatggaactgcatagtgaactccttttgtgtgggaactgttgccagtctgggccttgtcagtgttggaaggtcaagcgtaatctcaggacttacagacgctttgccagtccgtggcgacgaggacggcgcaataccgctccggtacgcgcctccgagtacaggctgcgcggcgcaaacgcccggataggcgcagcgcgcgccgccttcttcccgaccatcagcctgacaggctcggcgggaacggccagcgcgtctcttagcggactctttgaaccgggatcgggaagctggcgttttctaccgcaaatcaccttgcctctctttcacggcggcgcattacgcgctgacctggatagggcgcatgtccaaaaacagattgaaatcgcctggtatgaaaacgttattcagcaagcctttcgcgacgtggcggatggtctggcgggacagcgtacgctgaatgaccaggtgcaatcagaacaacgcgcggttgaagccagccaaatcgcctatgagctggccggactccgttttcaggaaggcgtcgatgactaccttacgctgcttgatacccatcgtatgctttatggcgcgcaacagcgtctggtacgcacacgtctcatgcaacagttgaatatcattagcctgtataaagcattaggcggcggttggcgggaatacagcgagaaaaagcaaggttagcccaaatagcgcgcgcgtcgccagtgcggcgcgcgcgctaaacaggcatatattgcctgcaaaataaggttaacgagggcaacgataaacgttcccgcttaacgtgacattcgtttgtttgcttgagcccgaaccgtgccatgaacttcctgtctggcctgcacgctgggttaacaggactaccgtattgtcgcccattttataagctttgtttttcagatcgttacgggcccccgtttccaggttactgttggaagtccagccaccggtaaagaaattcccctggctgcccgtgatatctcctaagtagctgcattccttacctggctcgctggtcatcacccgtacctgttcagcgccataattcagcgaattagcgctacatgcggttaaagccaagccgacgaaacatactaagatctttttcatactaatacctggtctattaatcattaaataataacgcgttcttgcttctgaacgccgtcaaggaactatatttaagatgtaacgaatgtctttcatttgctgaagaaaagtctctgtcatgatgctatcatgtatgcttgaggctatttcttgttcagttttttcaatatgctctctgagccttatttttgttttttcgtcaagcgccgagataagtatcttaatggcaagcagcaaagtaggattgatgctttcacactctctcatcgttaactttttcatcttgtttacttcaagcctgatcggcgtttttgtctacacggcaaattttagatgcgaagatatggcgacttctttggtaaataaatagcaaatggaaaaagcgcttgaagccatatttacgacagatacgcaatctatgaatgtacaaagtcttacgactaatgccatagctactggcgatctgactcatcgactttttatataaaaagtgccataacaactcttcctccttttttgtcaacggcgcaatttcaccgaccgctacatcgtttgcacaagcgtatttaatgaaatgctcaataaaaacaggctttgccaaatcgggatcgatatcaggatctctatcgcagccatgtggataaagttttccaatatctctgcgcgtgagccagattcgacgagcatgtggataatgctgcatgagcgccttaaaacctttccagaccccctgaatcaaaactcgtccatcaataataattatgatatcttcgctagctgatatctgacacgaattatattctccattaagtgggaacataaagcacttcccatcctcaaagagtgaagcgatgcctaaataagtataataatcatccgttaaaactatacctatcgtttttaacggaagttgttccgatagtgaatttataataatttcatcaatagaataacgctacggtgagtgttttatcttcctcttaagattacctgactgattataaccatccctactctgtagcaacgccatattatatttttagttccttgccataaacgtaacgcttatacttttaatatcagaagcgataacctacgctgacaccaaatgtattggtatccacagcgaagaaacggcttgcttcccatgatgcatcgatagatatactcttaacaggattaaatattacaccagcgccgtaggcaaaggactcttcttttgagtgtttattaaatttcatcgtcgctatacccgcattgccgtacaggctcacatagtcattaaagcgatatgttggtccaaacatcaaagaaccatagtccacagaatcggaaccatttttatgcaatttcccctctttccaggtgtagttctccatttcattgcgcgtcgcagtgaatgagcctaacatcccccaggtctcattgaactcgtaacgatatttaaaattaaagcctcgcagatctttgctatcgctatttttcaatgaactgagatgagtttgtgcataaccaaacgatacggtgtgctgatcgttagccaaagctaaaggtgacgctaataataaacctaaaaaaacaaggaacgaagaccgtcttttcattaaaaccactccatttttgatatataattaaggcggtaccggaacttatggcacacaaatagcatttagattaagagcacctaatgcgcttattaccagtcatgccaactgcggaggtaatataacctgatatattcgataatggatatgaaatcagtcttacagagttcttacttttttattaatagcggattcatagttgcttcagacccgatcctggcatcgcatccgtcaggcggactgcgagaggttatcagcgagtatcagttacctccctgtcgagtcaaaaattcataactcattgttttatatgcattttaattgattattgagttaacctttacccttgccgagggcaatttcgcaactcgctttctgacgcattcagacaacattcagatctactgcgcggtacaaacgttataaagctgccgattaagagaataaaaaaggttttctcacccactttagatattcgaatctcattagccgcttccggatgcagaacccgtaaatatgataacagatcgccagccgtgtccgtggcaaagacttttacctgggatacttcgaacgtataaacaccaggcgctgttcgatgtaaatttttcatatacacgtcccggtataatatttttacaccgttatcttttgtttttatttcatattgaagcgtaattctcttcatcttaaaatcaagaacaagactgccatcggcatggatatctttaggctgtatcgtcgttaccgttcttgtcgtacataaaaattcattagtattaatagaactatggttactgtttcgtacccaaactaccatcagtacgactgaaacagccaacataccaagcgtcgccacgcttaataacgttcttttatggaaatgcatttcggctccgctatatcaagttggttaagacactggacaaaaatatttgtattaggaacgcgaatgtaataaatgatttttccgttttgtttatgtatttcattactcatctcagagtacgcttcaatgatatccgccagatgggttttatcatgcccgacactataaaaagtgtatccatcatacgaaccattgagggtaaaataatcaatattttcacccttaactttataaatcataaaaaacatcagaagcgcggccaggcaaaagtagagccaatcttttctattcacagcgcccggtattgggggaataatagtatcatcgtgccgcacttcaaccgtcgataattctgtttcagcaacagcaggcaacggcatatcttgcgcctcatcactcaacggttcaatggaaactgagagtaaaacacccacgcgagggcgagtcacaacagactcccccttaagaccaattttatcaaatgatcctcgtagctggttaatcagtttataataactggcatcagagaccacaacacctttgcgcccccagacatagttaattaaatcatcttttttaaaaaggccttcataaaaagtgataagcaaactgcgttccgattcagatatcgttatcaactctccggcgcaggaaagcgtcattcgttcacaatcaagaataacccttttgtcaatcagataattgttctgactcataaaaatatccgccccagtgctatcacgtttcttcacggcataaacatattactaggatatatcgtgctattgaatttttttccgtagcgagttcctgcattattcagccaccagatcgctcgcggatccgctttcccccttgagcaaaccattttgccgctgggctgacttgccaagccaactcataaagtcattagtccccatcggcctggcataaagaaatccctgaacgaatcctaccccgtggcttaagatgtaacgcaattggtgctgggtactgaccccttcggcaaccacattgagtcccagtcgctgactcagcgtaatgatagtatccaggacaggaacatcatcgctgctggtatcaatggtatcgataaacgttctgtctattttaagagagtctacaggtaattgctggagataggagagggagcaatagccggtcccaaaatcatcaatcgctattaacacgcctttttcacggagcgttgaaagtttttctgcgacctgtgaaggttctacaatcaggctacgttcggtgagctccaacataagcgttatcgttcccaaacgagtcctgagcgcctctatatcttgcataaaaccgtcatccataagatgcgcaggcgatatatttacgctgatatagaaatcatccggtacagtccagtttatcacgtcatgagcaatcagttcgaacagatgacgagagagtggaataatcatgccttcattttctgcggcggtaataaaaatatcgggagttataaaacggccatccggttgcggccagcgcattagcgcctccacgccgccgcaactaccgtgtttaacattaaaaacaggttgataatgtaccgtaaattcattgtgcgttattcccctggaaatctcccgggccagagataagcgttttaaataccagcgcctgtagaacaatatcatccctacagaaagacataatgacagcggaataaaaataaaaaggttttgtaaccagtatgccgataacgttgagaaaggggttcgcaccatcagctggatagtgtgatcggttgaggtgaaccgctgcgttaaaaacgccttaccgcgcaacgtcgcagcgctggtaatcgcctctcctgcgccgaatatcaggctaaaggctgatgctctttctgcagccaatatctccatgagctcctggacatactgcgaatccacaatgacgaaagccgctttatccgctgctacttttttcacatacaccacaacaaggcgatcgggtccttcggccatactaccgatagatcgcaaccaccgttccggataagaagcaggtaaagaaagccctgccagccgggaaaaatgatagcgttcggttcctgtgacaaaggagcaagtgatatcaccattttccagaaacccaatgtcacggacataaggagtgaaggcccgcgttctggacagttctttcagcgtgtcagtacaggaactctcagccagtctggcggcttttccggcgacttgccaggaggcggcggatatatccgcgctaaaccgcagcagcgtattggcgctgacggcgatatctcgttttagctggaagatacccgcgagtaaccccaccaatatcattacgatcagtggaacggcaataaacaacatcagaaatagctttcttactttcaaatcattgccctcttaccggccttccttttgccactgtacgcttttataggataactaaagtaacattaatagagaaaagaaatattgagagataggttatacgttcttaatgatagcaagatggcactccctgtgccgaaaacagacaagagaatatcaatacccaacaggtgcaggatactatcgttaaaatgagcgataacagatatctaaataaagacgcattcaatatgttagcctgatgccaggttcactgcctgatgagacataaccatcacggaacgaattcccatcaatacagggattattggttacaactcaacgttactactggtggtacacacattatacaaatgccgattaagcgaaaacatgtaggtgtttttcccaattttgacaatttttagctcattaatcgtaccgggttgtaacaacctcaaccaggaaaataaatcgccagcagtatcagactcaaaggtcttaactgaattgactttaaaagtaaatgttttcatacccgttctgcgcagtttgctgatgcagatgtcacgaaaaaaaaagccgtttctctttcgtatcggtagtaacatcgtagtgtagggtaatcctgccggatttaagatccagcacaagtccaccatccatgtacaattttcgtggttcaatatacgcttctgattttgtcgtgcatataagattattggttctataagagtcacgatttacccactcaagcgctattaccgatccgattgcgacaatggcgataaatattacaaatataatcagtaacgttcttttactgtaatacattttggcaccgccatttcaacaggattcaagcattgcagaaaaatattcatatttggctccctgatataataaagatggcgtccattttgccggtaaattttaatttttagagagttaaaagcaaaaactacttcacttaatgtgaccttatcctcttttgttttatagattgcataatcgttatattcgccaagatatgtaaaaaaactatcagggctgttacgaacaggcgttttatagatagtaaatacaccatagaacaatgccagaagaatggctcctgttaatactacaaatacgctgtgacgtttaattttgtaaaatattttctcccgagtcgaggggcctttaacgttttcatcactcacctttagggaggtgattttttttataggttcaatggcaacagacagcgacacccccacccgagggcgagttacgatgccagatagctgtagaccgatgctactaaaatcatttctcatttgattaatgagtttatagtaacttgattctgagacgcagcctccacgattttcccaaacaaaatgaataatatcttcttttttgtaaagaccatgccaaaaagcaagaagcagatgggtatcagcttctgatattctgattatctcattaccatgagataaggtcatcttcgtactatcaaatacaacacgcttatcaagtaaaaatatgctttcattcatgacaatcctaaaggtaactgcatccatcattcagacgacatattatcatgctcaaaaaagaattcagccccctaattaacctgagtttaacttataactctcacttatagtaaacaataattgacacaagtattacctgcacattacaaatcaaacagttataggtaaatctgaacacttttctttaccttaacgcaaactcaggaaacttctgaaaggccaaaagtaagaaaaaagtaagactaattatactgtttcagaagcacatttcagaaaatttaccttaatctcaccatcgtattatccatcgggaggtttaactgatacggattttacatagcaaaaatgtgcaggttgtattgcaacatagtctatctattcagccgcggagagaattgttatcggattacactcaattaaatgataacactatcagttgtactaatgagatgtatggacgaaagcgcttatcgctctatttcatgatgagagaaataagtctgtttgttttatatcgcattatcaatagtcaggagggtatagctcacatccaaaaatagagttaatgatcgttatttttaccactcctccataagcacgaaacattcgggcgaattgcactcgtcctgaaaaagtaaagattaatacaggaacattattatatgtctatgaaaaaatatttagcaatgatcacaggctcgcttcttgtctccagcagcgcgatggctgtttctgataacaccatcacctttcaaggggaagtctctgatgaaacgtgctctgtcgtgattaatggtaatcaggctaaacccgtcgtgttattgccaacagtaagtactaaagagttatcagaacaagggaaaaccgcggggccaataacgtttgatattgggctgtccgggtgtaccggttctaaggacaaaacaacaaaaatttccaccgtctttgtcggtaatcaggtcaccagtaacggtaacctgggtaatactggcagcgcgaaaaatgttgaagtccaattactcgacacttcaggggagccaatcaatctgaccggcggctttactggcgacggcgacctacagctggaaccaaatgcttctgaagcgagcgcgacttataccgcgcggtattactctaccgggaaagcagaggctgggacagtcgctgccaccctacaatacgccgtttcgtataaataattgtcgctacggtctggcattgaaacgccagaccattttcaatcgccagggagttgttgagatgaaaatggatacccgacattccgcattatattacttaatagtttttctattgctggccctacccgccacagcatcgtgggcgagcgttactattttgggtagccgaataatttacccatcaacagcctcctccgtagatgtgcagttaaaaaataatgatgcaataccttatatcgtacaaacctggtttgatgatggcgatatgaataccagcccggaaaatagcagcgcgatgccgtttattgccacgccgccagtatttcgtattcaacccaaagcaggccaggtggtacgcgtaatttataacaacacaaaaaaattgccgcaggatcgtgaatcagtattctggtttaacgtattacaggtgccaccaacgaatattggcagcgacagcgggaaaaataaaatgttggtgatgctacgctcaagaataaagcttttctatcgtcctgacgggctaggtaaacctgataatctggcgaaaaaactacagattaaaacggtaaataagggttctggaaaaagcggtattgttatcgttaatccgcagccctggtttgcctctttaagtaacctgaatgtaaaagtgaacggcgcttcgtataacctggatgcagacatgattgcccctttttccagtcaaacctggtggctgccgggcaaacggtcactcaaatccttctccggtacagtcaccgttactttggttaacgacctgggcgcaaggataagcgagagctacgatgtcccccaccattaatttgaaccgcaaaagccttgcgctattgatcgccatagtttgctcaggctccgcgcagggtgaagagtattattttgatcctgcgctacttcagggggccacttacggacaaaatattgcccgttttaatgaacagcaaacgccttccggagactatcttgccgacgtttacgttaatggcacgctggtagcctcgagcactaatattcgatttaatgctgtaaaagagggtcaacaggctgaaccctgcctgcccttatcggtgatgaaagcggcacaaataaaatcactccccgagaccgacgctgcgaccgagtgtcgcccgctcagggagtgggtacctcatgccggctggcaatttgatagcgccacgcttcgcctgttgctgacgattccaatgaccgaacttacgcacaaaccgcgcggttatatctccccttcagagtgagatagcggcgcgctggcgctgtttttacgccataacacaaactggacccacaccgaaaataccgatagccattatcgctaccaatacttatggagcggtttaaacatgggcgttaacctcggactttggcaggtccgtcatcaaagtaatctgcgctatgccaatagcaaccagagcggaagcgcctggcgctataatagcgttcgaacctgggtgcaaagacctgtcgcatctattaacagtatcctgtcgctgggcgatagctatacggactccagcttattcggcagtctgtcctttaacggagttaagcttgtcaccgacgagcggatgcgccctcagggcaaacgcggttatgcgccggaagttcggggcgtagcggccagtagcgcgcacgtggtagtaaaacaactggggaaagtgatttatgaaaccaacgttccgccgggcccattttatattgacgatctgtacaacacccgttatcaaggcgatctggaggtagaggttatcgaggccagcggtaaaacctcacgtttcaccgtgccttattcttccgtgccggattcggtacgtcccggtaactggcactattcgctggccttcggcagggttcgtcagtactacgatattgaaaatcgtttctttgagggaacgttccagcacggcgttaataacaccattaccctcaacctcggttcacgaattgcgcagcgttaccaggcatggctggcgggcggcgtctgggccaccggtatgggcgcgttcggccttaacgccacctggtcgaatgcgcgcgcagagcataacgagcgccaacaaggctggcgcgcggaactcagttacagcaaaacgtttaccaccggcactaacctggtactggcggcttatcgttattcaaccaacggctttcgcgatcttcaggacgtgctcggcgtacgccgggaagcaaaaacggggattgattactactccgacacgctgcatcaacgcaatcgcctgtccgcgacggtaagccagccgttaggacggcttggcacgcttaacctcagcgccagcaccgcagactactacaataaccaatcgcgtataacacagctacaaatggggtatagcaaccagtggcggaatataagctacggggtgaatatcgcgcgacagcgcaccacctgggattacgatcgcttttatcacggcgttaacgaaccactggacgtgagtagccgacaaaaatataccgaaaccacaatgtcgtttaatgtctctataccgctggattggggcgaaaacagaacgtctgtcgctatgaattataaccagtccagtcaaagccgttcctcaaccgtatccatgaccggcagtagcggtgaaaacagcgacctgtcatggtcggtttatggcggctacgagcgttatcgcaatagtaatagcgatagcagcgcgccaacgacgtttggcggtaatctacaacaaaacacccagtttggcgcacttcgcgccaactatgaccagggtgataactatcgtcaggaaggactgggcgcgtccggcaccctggtactccaccctggcggtctgacggctggcccctataccagcgatacctttgcgcttattcatgccgatggcgcgcagggcgcgatcgtacaaaatggccagggcgctgtggttgatcgctttggttacgccattctgccttcgttatctccttaccgcatcaataacgttacgctcgacacccgtaagatgcgcagcgatgccgaactgacgggaggaagtcagcagattgtgccctatgccggcgccatcgcgcgtgtcaatttcgccactatcagcggcaaagcggtgctgatctccgtgaagatgccggatggcggcataccgccaatgggcgctgatgttttcaacggtgaaggcacaaacatcggcatggtcggccagagtgggcagatttatgcccgaatcgcccatccgtcgggttctctactggtgcgctggggaacaggggcaaaccagcgttgccgggttgcctaccaactcgatcttcacaccaaagaaccgtttctctatctgaacaaaatctgcgagaaggaatagcacaatgctttttagtttccgaacgctcttgtttatcaccagtctgttcgtcagcgccggaacatggtcgtcatgtataaaagtcaccgataagagcgcgctctctgacgcggcgataaaagcgggctacacggcgcaaaactggatcggcgcacttgacacgaatacgggtaatatcggtttgccaacggtgattagcatcagtaatagtgaaacatttcaaccctccggcacactattggccagtgggatcggtaacttcctgacggccgccaccggaacgccctattccagtaaacaggtactttaccgctgcgattccgccgatgccgggaagctctatgagatgtattcgacaaatggcgatagcgcttttgcgggggcattttttactcccgaagtagaaggcgcctattatgatgtggagcgtaatgtcgctgtccgtatgacaaacctcagtaccggcgaatattacagccgcttctggaaagaacgccaacttaccgcagacagttggtttcaggatgacaaatatatttatattcctgccagcgcgtttagcaacgtgttatatgagatgtttaaaattgactcaagaaaatattttgcctaccagaatccaatggaccgagatacctggacgcagcctcggggttatatcgcgtttaaaggcccaggcttgattaccgagcggatcaaagcgggactggatcatgccagcgattattatggctggcccagctattggcccggggcatggagtacatataatagcgtcacctatgttcgcggcgcgttatgtaaaatcacagattatcctgcgatcgtgaaaattccccctgtcgccgtcggcatattagccgccggaggcaatagtcaggcgcctttccacgtcagcctagaatgtgagtccggtgccgtgtccagtgccctcccgtccaccagcgccgctaatgtcgcaatggggtttgtcgttaatcaacccaccgccgtggcggcggcgcgtcgcctggggctaaccacatctgcaggcggtctgtcgtggctactggacacccattatggcgaacctggcgtagcttccggagtgggtatccgcatctataacgatgccggtacgccgattaacctgttacccgatcggatcaagacaggcactggcaacgcccgaggctggtatggctataaagatttaaccacacgggtatcatccggttcagtagaaacctatagcggtgattttactgcctcgcttgaggcgctcggcggacaaacagtaacggcaggaagcgtgaatgcgcaattacaggcagtggttagttttcagtaaagtcatattaacgctacttgggttgacgggatggtatggcccggcacaagctgccgttaatattgacagaacccgaattatttttgcttcagatgaggtcgctcaatcgttgacattatccaacgataatacaacgccgatgctgttacaggtatggaccgacgccggaaacattgacgcctctccggataacagcaaaacgccgctggtggcgctgccgccggtatttaaaatgcagccaggagaactgagaacgcttcgcctgctcctgagttcccgccagcagctggcaacggaccgggagagtctcttctggctaaacatttatcagataccgccagtcacccaggacattaaaaaccacccgcgaaaactggtgttaccgcttcgtttgaggctaaaaattttaattcgcccgactgggctaaaagcgcccacggaagcggaggagaaaaaattacgctttattgctaaagagaatactatacggatagttaaccccacctcgtggtatatgagtttaacgttaacgatggataacaagaaaagtatcggcgatatcatggttgcgccgaaaacagcacttgatgtgccgctaacacgctcgccaacgccgggagcatcgataaattatgcagtaatcaatgattccgggaactggcgacaatataccgccatactggaaaaatatattagtaagagtaattttattcctgagttttgatgggaaatattcagggatacgatcgtatccctgagacaggccagaattcagcatgtaccattgtcaaaaatagcattaagctgatattttactttttgcacggcatctttgttctgttgagttcccttctcctcaacagacatatcccatacgtttttattatctgattcaattaatgagtagaacgtattattattacgcatcatataaccacgaaaattattttcgatgcccgttgtcacaggcttggcagcccctgaaataacagactccgtctctttattgaaaagctggtattgaatatttgcgcagtttaaatcacagggggaacatttaagatttaaaacaagcagtatcgtgttattttcaaaaacaagggcataatgattgctggcagatgaacataacgggaataacgcgagaagaagaattattatcaatttcatattattatatagactccgtcaaagaaaactttcatttcacttgttcttctgttaactcaccctttcatttcacgcccctgagaatagcgaaaggcataccatgcagaatgaatgctttccgaactgacgtcctcacagacatccataccatgccaaacaagtacgcgagaaagaaaatgagaagattgttatgaaagaaaagtttgtaaccgcttgattgagatggtgccgataataggagtcgaacctacgaccttcgcattacgaatgcgctgctctaccaactgagctatatcggccctgagaagggtgtgttcacgcgggtgaatcacggggtagaaggttaaaactaaccgggcggtgcgtcaatagccttgctactcaaccggctatttttgcaccgctcgtcattaattacgcacgaatcgtaccatcgccaaagcctatccacttataggtggtaagcgcttcaagccccatcggaccgcgggcatgtaatttctgcgtgctgaccgccacttctgcgccaagcccaaactgcccgccatcggtaaaacgggtagaggcgttgacataaaccgcagcggaatctacttcgttcacgaaacgcgcagcattatgcatatcgcacgttaaaatcgcatcggagtgctgagtgccatgttcgcgaatgtgggcgatagcgccatccatattttcgaccaccacaacgttcagatccagagacagaaactcgttatccagctcttccggtttcagcgccaccagtttggcagggccatgcagtgcctgcatgacggtttcatccccatgcaacgttacgccactctccgccatctgcttgctcagcgcaggcaaaaagcgttctgcgatgtcctgatgcaccagcaaggtttccaccgtgttacaggtgctcgggcgctgggttttagcgttgacgataatcttcagcgctggggcgatgtctgcgctgctatcgacaaaaatatggcacacgccaatcccgccggtaatcaccggaatggtggattgctcgcggcagagtttatgcaagcctgcgccgccgcgcgggatcagcatatcgatgtacttatccatacgcagcatttcactgaccagcgaacgatccggattatcaatcgcctgaaccgccgcttccggtaaatcgcaagctttcagcgccttctgaatgacaagaacggttgcggcattcgtgcgatgcgtctctttcccaccgcgtagaatcaccgcattaccggttttcagacacaaagaagccacatcaacggtaacattcggacgcgcctcatagataacgccaaccacgcccaacggcacgcggcggcgctccagacgcaggccgctgtccagcagaccgccgtcgatcacctgcccggccgggtcggcgagattacagacctggcgcacatcgtcagcaatcgctttcagacgcgcaggggtcagcgccaggcggtccagcatcgcttcgctcaggccattggctcgcgcctgctcaacatcttgtacgttcgcgctgaggatactttccatttgcgcttccagttcatcggctattttttccagcacgcgatttttttcgcagctggagagcagcgccagcttatacgacgccgctttagcagcaatgcccatttgttccagcatatgcctgttccttatcgagtaatcatgtcatcacgatgaacagcgaccgggccatattcatagcccagaatcgcatcgatttgttgagagtggtgaccggctatccgccgcagagcatcactgttataacggctgacgccatgagcgatatcacgcccttgcaggttacaaattctgatgacctccccccgcgaaaaattgcccgtcacgcttttgatgccttttggcagaagtgaactgccacgttccagcattgccgcggtcgcgccttcatcaaccgtaatttcgcctgccggcggcgcgccgaagatccaacgtttgcggttctccagcggcgaggcttgcgcatgaaaacgggtgccgacggaaatcccctccatcacatcgccgatcacgcccggtttactgcctgaggcaataatcgtatcaatacccgcgcgacaggccacgtctgccgcctgaagcttagtgctcataccaccggttcccagcccggaaacgctgtctcccgcgatagagcgcagcgcatcgtcaacgccatacacatctttgataagctccgcctgcggattgctacgcggatcggcggtaaataatccttgctgatcggtcagcagcagcagtttatccgcgcctgccaggatcgccgccagcgcggagaggttatcgttgtcgcccactttaatttccgctgtcgcaacggcatcattttcattgataaccggcacaatatggttatccagtaacgcacgcagcgtatcgcgggcgttcagaaagcgctctctgtcttccatatccgcacgcgtcaacagcatctgcccgatatggataccgtaaattgaaaacaactgctcccacagttgaatcagacggctttgccctaccgccgccagaagctgtttagaggcaattgttgccggcagttccgggtagccgagatgttcacgtccggcggcaatcgcgccagaggtaacgataacaatacgatgtcccgcggcgtgtagctgcgcgcactggcggacaagttctacgatatgggcacggttcaggcggcgcgatccgcctgttagcacgctggtgccgagttttacgaccagcgtctggctgtcactcatgattctctgccgttcaaaataagaaataaagaccaaatgaacgttttagcaggactggctccggttgccaacaacctgtacgcgtagcgtgaaattttgttgcgcaggatcagcaagcgtagcggcggaatttgaccattttattaccgcaacaattaaatatatttttttaaaaaaactctcactttgtcataaatctttcattaccgaacgttaaaaaccttcctgttttttaccgggtctcccgacaaatcatagcgcgtaattaaaacaggaatggaaatgaataagagcactctggcaatagtggtgagtatcatcgcatcagcatctgttcacgccgccgaggtttacaataaaaacggtaataagcttgatgtgtatggaaaagttaaagccatgcactatatgagcgattatgacagcaaagatggcgatcaaagctacgttcgttttggttttaaaggcgaaacgcaaattaacgatcaattgaccggctacgggcgctgggaagctgagtttgccggtaataaagccgaaagtgattcgtcccagcaaaaaacccgcctggcctttgctggtctgaaattaaaagatatcggttcttttgactatggacgtaacctgggcgcgctgtacgatgttgaggcctggacggatatgtttcccgaattcggcggcgactcttccgcccagaccgataattttatgactaaacgcgccagcgggctggcgacttaccgcaataccgatttcttcggcatcgttgatggactggatcttaccttacagtatcaggggaaaaacgaagatcgcgatgtgaaaaagcaaaacggcgacggcttcggcacttccgtgagctatgatttcggcggcagtgattttgccgtcagcggcgcttatactctctccgatcgcaccagggagcaaaatctgcagcgccgcggtacgggcgataaagccgaagcctgggctacgggtgttaagtatgacgcgaatgatatttatattgcgactttctattcagaaacccgcaacatgacgccagtttccggcggatttgccaataaaactcaaaacttcgaagcggttatccagtatcagtttgactttggtctgcgtccgtcattaggctatgtgctgtcaaaaggcaaagatattgagggcgtcggcagtgaggatttggtgaattacattgacgttggcgcaatctattatttcaacaaaaatatgtccgcgtttgtagattacaaaatcaatcagcttgatagcgataacacgttaggcattaatgacgatgatattgtggcaatagggttgacctaccagttctgataagtcgcattgtgcctgatggcgctacgccatcaggcatggcagcagggttatgccgacagttttaccggctcgtcgttgaaatcgtcagacggctccagcgccagctccatagaaatcagcaggtcgcgtagcttttcatgaaactcgcgtagcgtgtattccagtcgctccaccacttcggtttcgttaatcggcactacggtccagttgccctctttatcaaacaaaccaaactgataacgataagtgaagcgtttctcttgtgcttccagctccatccaccagccccaaaattcacgcttctctggcgcgggcttcacgttgacgcaaactgccaggcaatcgaaaaaaaaacgattgtcttcgcactgcccttcccggatataggggccaagcgcggtaaatttcttgatcaatctacttttcgggtgtccactcggtaacgtcattgcgatctcctttaatgaagcaactgttttaccaaatcaatagaatttatcaatctattaacacaatctatgattaatccagtcggtaatttcttgcagcgcgtggtcaaaattgcggtacaccgggttaaaagggatctctatcagcttaccgtctgaagatgatgttgtaattaagcgagactcttcttccgggctgaaaggatcgtttttccagaagccggaaagcattggcgtaggacaacgtctgcccagtagcccctgtactttcaacgaatagcggttgagctccacacgcagcgcctcatccgaagcatcatgcatacccagacggctggccagcacatccagatacatctccggcactgtgctctgtcgttgcggatcgctaagtagcgcatggaccaccggccccaggcaagccaccgctttcaaacgcggcgcttccagataggccagacgcaccgcaacgttggcgccaaaacggaaaccaaacgccgcaacacgggtatgatccacccaggggacattaggaagcgcttttaacacatgctggtggagcaagctggaatcctgggttaatttccactttgatgaaaatccaaccgaaggcatatcaagcgttaacatcgcgataccgcgcggcgcgaaatagcgttcatacagggtgtaatagtcgatttgcatggcgtccaggccgccgcacatgagcaccgtcggaaacggaccatcccctttcggcatatgtaaaaacgcggtgacaggcgaaccgccaggaacggcaaattccatttcacgtaacgagcctggcaaccgctgcgcggcctcttcataggcgcgattcgccagcgcctgcgcctgctccgccagctcatcgcccttcaaatgcgggtaggcggcaatgttatagagcgttgaggcatgaagccagtagcgtccgctgcgcatggcgtcctgttcctgacaggctttctgctgccagtccatcgcctgctttgcccactcataaatccagttgccgccgcggtaaccgatgaccgtatcgtataaatcatcatccgttcgctctgcgtcgctcatcacaatgcgcgcctgcacatcaaggatttctcgtgggtcaacgccgcgccaaatccacatcaggcggtttatcatgcgataccaatgcgggacgttcttaccgtccagcgcggattgcatgggcggctgcgacccacgattgaaccgacggacaagggtagacgtttcagtatgtttaaagcggggtttgaacagggtttcgctgaggttagcctgtgtcattcgtgcagcctccttggatactcatagaggcttattgtaaccaataaaacagcgcccggcattgccgggcgctctgaaaagctgctgattaacgacctgaaatcggcggtacaaataccacacccatatcccagggctgctcaatccaggtgttctgaggaatatcaataacataatcatcaaccagcggacggcccgccggtttagcgaaaatcgtgacgaaatgcgctttagggtacatttcgcgaatcgcgacggcggtgccgccggtatcgaccagatcgtcgatgacgataaagccttcgccatcgccttctgcacgtttcagcactttcagttcgcgctggttatcgtgatcgtagctggagatgcatacggtatcgacatgacgaatgcccaattcacgcgccagtagtgcgcccggtacaaggccgccacgacttacagcaataatgcctttccattgttctgaaggcatgaggcggctcgccagtttgcgtgcgtgaatctgcaacatgtcccaggtgacgacgtatttttcgctcatgtgaagtgtcccagcctgtttatctacggcttaaaaagtgttcgagggggaaatagttgcgcgagattatagagacctgacgcgctaaaaaccagtgtttagcggaatccacgcctctttttgtatgctttatactacccgcaggcggagaaagtggtattctcagtcgcatctcgtaagagttattaattccgctaaccctgtggcctgtaagaacgtttttcagaccaccgccaaggagacttatcgtgtctgaactgtctcagttatcaccacaacctttgtgggatatttttgccaaaatctgttctattcctcacccgtcctatcacgaagagcaactcgcggaacatattgtgagttgggccaaagagaaaggcctttacgtggatcgcgaccaggtcggtaatattctgatccgtaagcccgccactgcaggtatggaaaatcgcaagccggtcgttttacaggcgcatctggatatggtgccgcaaaaaaatagcgacaccgttcacgacttcactacagatcccatccggccttatattgatggcgaatgggttaaagcgcgcggtactacgctcggcgccgacaatggtattggaatggcttctgcgttagcggtactggctgacgataatgtcgtccatggcccgctggaagtgctgctgaccatgaccgaagaagcgggcatggatggcgcgttcggcctccagtccggctggttgcaggctgacatcctgatcaacaccgactctgaagaagaaggtgagatctatatgggctgcgcaggcggcatcgattttacctctaatctgccgttgacccgtgaagctgtacccgcaggatttgcatgctttaagctaaccctgaaaggtctgaaaggcggccactccggtggtgaaattcacctcggccttggcaatgccaacaaattgctggcgcgttttctggccgggcacgcagaagaactggatctgcgtctgatcgatttcaacggcggcacgctgcgtaacgcgattccgcgcgaagcgttcgctaccctcgccgttgccacagacaacgtaggcgctctgaaaacattagtgaacgcttaccaggatattctgaaaaacgaactggcggaaaaagagaaaaacctgacgctgcaactcaatgaggttgccagtgataaagccgcattgaccgcgccgtcacgcgatacctttgtgcgcctgctgaacgcaacgccgaacggcgtgatccgcaattcagacgtggcgaaaggcgtagtggaaacatcgctgaacgttggcgtggtcacaatgtctgatgcgaatgtcgaaattcactgcctgattcgctctcttatcgacagcggtaaagattatgtggtgagtatgctggattcgctgggcaagctggctggcgcgaaaaccgaagcaaaaggcagctatccgggctggcagcccgatgcgaactcgccggtcatgcacctggtgcgggaaacctatcagcgtctgttcaacaagacaccgaacatccagattatccacgccggcctggaatgcggtctgtttaagaaaccctatccggatatggacatggtttctattgggcctaccattaccggacctcactctccggatgagcaggtacatatcgaaagcgtgggccactactggactctgctgaccgaattgctgaaagcgattcctgcgaagtaagaaagcgctaaaatgcccgtctcatttctggacgggctatcaatatggaatatcgggtatccattgccagataagctctcctggatgcgctgaatagcgctgcggctacacgcgaatagccagacagccctataacagcgctggtagcaccgaattattgtggcgtaaacgccattcctttaaatatccgtagcggattgccgcgctcaatctgatgatggaacagacgcctttcagacttcaacgccgcacactcattttgccgttgctgttccagccgccaggcaatcagcagccgggccagacgcttattcgcatgttgactgcgctccgactgaaccttcacgctaatcccgctcgccaggtgcgtggcccgcactgccgagtcggttttattaacgtgctgcccacccgggccggaagagcgcagagtctcgaaacgaatctcatcagactgtatgtgctcgtcggcggaaaagcgcccaatgccgacgtaccagttttttcgcccatggtgcgggcgatacgggctggtacaaatccacagtaacgtgccgcaccaacgttcactgaaagccatggctttttcgccgtccagcgagaccagcgcagaacgcagcgtgtctggtaatcgtcccggctctgtttcaagccgtgtcagcgataccttttctctggcggcttctttcgtcagacaatccagcgctttttttaccgccagacaacactcgtccggtccctgcgcagaagaaagttgcagtaagatcatgcgcttttctcccctgaggttttcagcgtcagcaccggacgcaggcaggcaactggcgtaatcagtccggcgtctgccagacaatccacaacgctatcgatggatttatacgcctgcggcgcttcttcataaatgagctggcgatcgcggcaaatcacccggctacccatcccagtacggcagagctgtcgcggggtaaattttgccgataaccggtctttacactcggtacgcatccatttgcgccccgcgccgtgcgccagggagaagaggctctcctcgctgacgacgggtttcaccagccagctataatcgccgcgcgagccggggataatcaccagtccctgcccatctggcgtagcgcctttacggtgcagccaccccgcctcacccgcgacagtacagggttcaacgaagttatgcgccacatccagccgcggttcgccctcagccctgagctgttgcagtatccggcgggcaatcagcgcgcgattactgcgggcaaatgccagcgcatcgtcatgttctgcaaggtagtggcgcgcatcgtcgctatcttccggcaaaccgttatgcgaaaacgcctccacatgacgacgcaggatagcttgccccagaccgcgtgaaccactgtgtaccagcagtaataactgcgctttttgcaaccccgacaaagcgaacgaatcagcatcgacgatgcgatcgacctgctgcagctcggcaaaatgattgccgccgccaatggaacccagcgcagagcgccacgaatgatgctgcattacggcggggacattctcctccagccactgcgcgtccgccacgtcaggcagcgacgccagccgcttctccagtttatcggcgttatatttacgccctaaaatatccgtttgccataacgccatgccgcagccgatatcgttgccgaccagcgccggataaaaacgtccacgcgagaaaaaggctgcgccaataggatagccgcgccccggatgcagatctggcatcccgataacgcgtttcataccggttaacttagccgtcgtatataattgttggatcgcggaatcttcgatccacaggttatccgatgcgatagaaaataccacatctgataaaggacgaatataattgcccatataccattccatatatgaattaaaaaatcaggaaatggcagactaatccagggcaataaaagaaaattaatcctggaaaggtctgcaaagtgcgttcagagaataaagtgtcatgatgaacctcctttgcagttattgagaatgagaaaacgcgggtatagtaatactgaaatttagatggcgcaatcgtaatagtgataaaatcttaatagcctgacttataaccctaacaccaactgtcgttccaactgagggtcgagcagcgttacgtgtagccccaccaaccgtacgccgcgctcgccgcgacgctcgtcccaggttttacgggcggtggtaattaagtcttctttatttaattgcggccagacatgttcctgagtggtttgctgaaaatcattaaattttaatttaacgccctgtcgggcaatcagtaaatcgggctttactatagccagacgacgctccagttccggatataaatgttcaataatggcctcgcagtccgaccattcatgaatatcctccgccagagtacgctcaacgcctaccgatttacgcagcctttcgctgttaacatcacgctcgtcaataccctgactacgctcccataatacccggccaaatttaccaaagcgtttgagaagcatcgccagatcgcactgttgaatatccccgcaggttcttaaccccatattttccagtttggcggcggaaactttccccacgcctggaattttggctaacggcaacgttttaagaaagtcgggtacatcggctggcgtaataacatattgtccgttcggtttattgagatcggaggcgatcttcgccagaaatttcactggcgcaacgccggcggaggcggtgagttgcagttcattgaaaatagtctgacgaatctccctggcgatcagagttgccgaaccataacagtgcgggctgtcagtcacatccagccaggcttcatccagcgagagcggttcaatcagtgaagtgtagcgggaaaagatgtcacgtacatgccgcgaagcctctttataggcgtcaaagcggccaggcagtaaggtgagatgggggcacagctttagcgccatggcagtcggcatcgcgctgcgtacgccaaactggcgcgcaggatagttggcggtactgataacgcctcttcgctcacgactcccgccaatggcaatggggatatcgcgtaacgccggattatcacgcatctctaccgcggcaaaaaaacagtccatatcaacatgtatgattttgcgcatcgctcgcccccacaatactgtttaagtgtacagtatgttttattgcgcgcaaagagacattcgcgttaaaaatgcgacatattcgaaggtatgacgacgaaagcggcgggaaaattgtaaacgtacacacggggacttgcgaaaaactgccgtggtgctaatgtgagcgctccaaatccagattactccgatttggggactcttttgccgttctggcgtgtgtaaccgttttatcaaggaacaagcagtatgcgtaaaatcgcattttttcttgcgatgcttctgatgccgtgcgtctcatttgccggtttgctgagcagcagcagccccgtcacgccggtcagtaaagagtataagcagcagttaatgggctcaccggtctatattcaaatttttaaagaagagcgcacccttgatctctacgtcaaaatgggtgagcaataccagttgcttgatagctacaaaatttgcaactattccggcgggttaggcccgaaacgccgtcagggcgattttaaaagtccggaagggttttacagcgttcagcgtaatcaactcaagccagacagccgtttttataaggccatcaacattggttttcccaatgcctacgatcgcgcgcatggctatgatggtaaatatctgatgattcacggtgcctgtgtttccgtcggctgctatgccatgaccgacagcggcattgatgagattttccagtttgtcaccgccgcgctggtctttggtcagccaagcgtacaggtgagtatttatccgttccggatgaccgacgccaatatgcagcgtcataaatattcatattacaaagatttctgggcgcagctaaaacccggctacgattattttgaacagacgcataagccgccaactgtttctatcgttgatggacgttacgtcgtgagcaaaccgttgagtcacgaagtcgttcagccacagctggcctcaaattatacgctctccgaggcaaaataacgcccattcgcctggcataatcttttgccaggtttcattccccgttagcggctgggtagcaatcacggtaaccacgtcatttggcgtggtctgtgaactgaaatcaatttccatatcctgatccaccagcgtggctacgccaaacggcgcccggcgagtgatccagtgcaaatgggttgagcaaaacgccatcacatatcgcccatctgacagcagcatgttaaaaacgcctttttcacgtaataccgtcgccagtgtcgcaatatatttaaataccgctgtcatgttgcccggcgtgcggggataacgctgcgttaatttatgcaatagccagcaaaacgctttttcgctgtcggtttcccccaccggacgaaaattaccggtttccagcgacttataaccgttgagctgaccgttatgagcataagtccagttgcgtccccataattcccgggtaaaagggtgtgtattttccagcgctacttcaccgcgattagcctgacggatatgagcgataaccgagcaggacttgatcgggtaattctgtaccagtttcgcaatcggcgaatggtagctcggttgcggatctttaaacgtgcgacagccctttccttcgtaaaaggtaattccccagccgtctttatgcggcccggttccgccgccacgctgcaccagtccggtgaagctaaagcagatatccatcggcacattggcgctcatcccaagcagttcgcacatacatcacctaccttaaaacggttaattgcctgataagaccagcaaagcacagctcgtaggccggataagatgcttgcgtcgccatccggcacaatgcccgatggcgcttcgcttatcgggcctactcgttccaggcccgataagaccggcaaaaattatcggcttatttaaccatctctttttcgatcaactgaatcaggatatgaatcactttgatatgaatttcctgaatacgatcggcataaccgaagtgcggtacgcgaatttcaatatccgccgttcccgccattttgccgccgtctttgccggtcaacgtaatcactttcatgcctttttcacgggccgcggcaatcgctttaatcacgttaccagagttacccgacgtcgagatccctaacaggacatcgccttcgcgccctaccgcctcaacgtaacgagagaaaatatagtcatagccaaaatcattactgacgcaggatatatggctaacatcagaaatcgcaattgccgggtagcccggacgattttcacgataacgacctgtcagctcttcagcaaagtgcatcgcatcgcaatgggagccgccgttaccgcaggaaagtaccttaccacccgctttaaaactgtcagccaacaggaccgccgcgcgctgaatggcgtgaatattggcgtcatcttttaaaaaattagccagcgtttccgccgcttcgttcagttcgttacgaataagatcctggtacatgaggatatccttcagcatgaatgtaaatgacagtatgcagtgtaccggatagcagtacaggcgagaagcataagccgaattaacgcctcacgcttttgatttttcgtgcccccaaaaacggcaacaatgtgagctttgttgtaattattttgtaaacacattgctaaaagattttacatccactacaacctaatcatcacaagtggtcagacctcctacaagcaagggagcttttcgttatgatgattttgagtattatcgctacggttgttctgctcggcgcattgttctatcaccgcgtgagtttatttctcagcagcctgattctgctcgcctggaccgccgcacttggcgtcgctggcctgtggtccatctggctgttggttcctctggccattatcctcgtgccgtttaacctcacaccgatgcgaaaatcaatgatttccgcaccggtgttccgcggcttccgtaaggtcatgccgccgatgtcgcgcactgagaaagaagcgattgatgccggtacaacctggtgggaaggcgatctgttccagggcaagcctgactggaaaaaactgcacaactatccgcaaccgcaactcactgccgaagagcaagcgtttctcgacggcccggtagaagaagcgtgccggatggcgaacgatttccagattacccatgaactggcggatctgccgccggaactgtgggcttacctgaaagagcatcgtttttttgcgatgatcattaaaaaagagtacggcgggctggagttctccgcttatgtgcagtcccgtgtactgcaaaaactgtccggcgtctccgggattctggctatcaccgtcggcgttccaaactcactcggccctggcgagctgttgcagcactatggtacggaagagcagaagaatcactatctgccgcgactggcgcgcggccaagaaatcccctgctttgcgctgaccagcccggaagcaggttctgatgcaggcgctattccggataccggcgtggtttgcatgggcgaatggcagggccagcaggtgctgggtatgcgtctgacctggaacaagcgttacattacgctggcgccgatagctaccgtgttgggcttggcgtttaagctttccgatccggatagattgttaggcggagaagaagagctgggtattacctgcgccctgatccccacctcaacgccgggtgtggaaattggtcgtcgtcacttcccgcttaacgttccgttccagaatggcccaacccgcggtaacgatattttcgtgcctattgattatattatcggcggccccaaaatggccggacagggctggcgtatgctggtggaatgtttgtcggtaggacgcggtattaccctgccgtccaactccactggcggggtgaaatccgtcgcgctggcaaccggcgcctatgctcacattcgtcgtcagttcaaaatttctatcggcaagatggaaggtattgaagaaccgctggcgcgtattgcaggtaacgcttatgtgatggatgccgccgcatcgttaatcacctacggcattatgctaggcgaaaaaccggcggtactgtcggctatcgtgaagtaccactgcacccaccgcggccagcagtccattatcgacgcgatggatatcactgggggtaaaggcattatgctgggcgagagcaacttcctggcgcgtgcttaccagggcgcgcctatcgcgatcaccgtggaaggcgcgaatatcctgacccgtagcatgatgatctttggtcagggcgccattcgctgccatccttatgtactggaagagatggccgcagcgcagaataatgatgtgaatgcctttgataaactgttgtttaaacatattggccatgtcggcagcaataccgtccgcagtttctggcttggcctgacccgcggattaacgagccatacgccaaccggcgacgccacgaagcgttattaccagcatctgaaccgactgagcgcaaacctggccctgctgtccgacgtgtcaatggcggtactgggcggcagcctgaaacgccgcgagcgtatctccacgcgtctgggcgatgtgttgagtcagctttatctggcctcagccgtactgaagcgttacgacgacgaaggccgccacgaagccgacctgccgctggtgcactggggcgtacaggatgcgctgtatcgtgctgaacaagcgatggacgatctgctgcagaacttcccgaaccgcgtcgtggccggattgctcaccgcgatgatcttcccgactggccgtcattatctggcgccgtctgataagctggatcacgccgtggcgaagatcctacaggtgccgaacgccacacgttcacgtattgggcgcggtcagtatctgacgcccgccgaacataatccggtcggtttactggaagaagcgctgcgtgatgtcatcgctgccgaccctatccaccagcgcatctgcaaagaactgggtaaaaatctgccgtttactcgtctggatgaactggcgcgcaatgcgctggcgaaagggcttatagataaagatgaagccgccatcctggcgaaagcggaagagagccgcctgcgcagtatcaacgttgatgattttgaacctgaagcgctggcgaccaaaccggtaaagctgccggagaaagtgcgtaaagtcgaagccgcataatcagtctcgtgtctttcctgccccgctttcgcggggctttttcttgccgcttttttattattgctcatgctacagtgtaaagacgctgttcaatgaggagctccgatcgtgtctggtttgaaaattactctgttgcaacaacctttagtctggatggacggcctggcaaacctgcgtcattttgacagacagctagagctcgtatctggccgggatgtgattgttctgcctgaaatgtttaccaccggcttcgcgatggaggccgctaataactcactttcgcaagatagcgtgattacgtggatgcaggccaaagcccgacaaactgacgctctgattgccggcagcgcggcgctacaaactgagcgcggcgccgtaaatcgcttcttactggttgaaccggaaggcaaagttcatctctatgataagcgccatctgtttcgtatggcggatgaacatcaacattatgccgcaggcgataaacgcatcatcgtgcagtggcgcggttggcgcatcctgccgttgatctgttacgatctgcgctttccgatatggtcgcgcaaccgcaatgattacgatctggcgctgtatgtagcgaactggcccgcgccgcgctcgctacactggcaaacattactgacggcgcgcgctattgaaaatcaggcttatgtcgcaggctgcaaccgggttggcaccgatggcaacgggttacattatcgcggcgatagccgaatcattaatccccagggcgacattatcgccaccgccgaaccacaccaggcgacacgtatcgatgcagatctttctctcgtcgccttgcaggactatcgcgaaaaatttccagcctggcgcgatgccgatccattcaccttgtaagcaacctgccgctcaccgcggcgggattgtttcactccgtaactctccgtaaaacaaattcgcgtggcgtaatgtggcaggcaacgtattctgactaagagcctatcccaccaggcgttattggcgcagtcagtttggacacggacagcgcgcaaaaaccggagcgtacacgtagtacgtgaggattttgagcactgcccaggtccaaaatggcaagtaaaatagccctaatgggataggctctaagataattgctcgccattcgtgggtaataaaaacggttaatcactcccttatcaggatatcttcatgaaaaactttgtacgcacaactttactggcagcgactctggcgggcgtttcttttggcgctttcgccaccgctgttcccaatcctcccctgcccgcccaggatcctattgtccagcatctgaagctgacaaacgatcagattacccggatcaaaaaacttcaccaacaactggaaaccgacgtcagtcagatttctatgaagggaattaaagacggtgcgctgatagaggtgattaaatccggtaaatgggatgacgccgccgtaaaacagcagcttgcagccttcagtaacatagaacaacaggctcgctattatcgggttaaatattattttgatttaagcaaagtcttaacaccagaacagcgtcaacaggtacaacaagatctcgcccaagcacttgagtaaatatttttgcccgttattcctggataacgggctttatccaggtcgggtacaaattcatctttttcttacagcatcgcaccatctcacactacccgttacacaacgtagaagtgaaaccgtacgtggggcaatttggcgaggagatggatttccataccgacgattatcgtattgttatttaaaatcttcatctcattttttacccgcttacagaaaacccagcgttacaatagaccgttttttgggcttcgtttatgtaatcgttatatcacaccctataccgtgaaacttgtcttttagcccaatattaaggcaggttctgaaatgaaaaactttttcgcagtctgcatcattccccttgtggtaacctggtccgctactgcatcagcaaaagaagggatctatatcaccgggaaagcggggacatccgtagtcaatgtctatggaatcaactcaaccttcagccaggaggagatagtcaatggtcatgcaacgttacctgaccgtaccaaaggcgtttttggcggcggggttgctatcggttatgacttttatgatccattccagcttccagtacgtttagaactggataccactttcagaggtgagacggatgctaaaggcgggcaggatattattgcatttggtcagccagtacacataaatgtaaaaaatcaggtccgaatgaccacttacatagttaatggttattatgattttcacaatagtacggcatttacaccctatatcagcgcaggcgttggcctcgctcatgtgaagctaagtaataacaccattcctgttggttttggtattaatgaaactctgtctgcttcaaaaaataactttgcctggggcgcaggtatcggtgcaaaatatgctgtaacagataatattatgattgacgccagttataaatacattaatgcaggcaaagtgagcatttcaaaaaatcactatgctggtgatgaacataccgcttatgatgcagacacaaaggctgcctccaatgacttcatgctcggcattacttacgccttttaaacactatcggtaaaatagctggtcctgtgggttcccgaaggcgcaatggaggatatcagtaatgaatactcctgcgccttcagaaaatcgttgaacaggtgcaacctggcgccatttttcagtacactgcaacgtttctggtatgggcttaacttccggctacccaaaaacagtcccgtcctgttgtatgatctctaaatgtgaatggcacgattatgcgagatacttacaagtgtctggtatgaagatatactgcgaacgccgatgtaaacggcgcgcgtaacattttagagcgggacacgccgtgcttgcctgtggaaggagcgtgcagtcaggcagcccgttggagcaggaacccacgcccttcaggacgtggaggatgtcaatgcacaagaattggggaatctttagcagaatttattatctctacagtagcatctctcttgttcccgtcataaataacccaatgcctccagatctgaaaccgccttcagcatgagcactggctgcaaataacaccaaataaaataataatataacaactaccgagacaaaaaacacctctctaaagtatttagaattcatacagtcagctcatttaaatttaacgtcacatgcaaccatgcatgcgtaaaacaagaaccacactcatattaataatgattagtaatgtgagtgtgcgtataacgagatacagatgtatattccttaatgtaacggaacatcatcaatgcaaatagcaaccatcgatatattaaactaaaataatacatctagtgcatatataaaccattcgtatggtggctgtaataaaattgttgataaacggtcatcccctaaacttccagcctccccaccgcacgaacaatgatgttctttatatttaatcgtaataaaaaacaaaacaataattaaacaaaaaataaataagatatttttgattcaaattttcactccttctgttatatacaccaagtttcattttttttatgatcccgaaagaaaaaaccgtcatatgacgatggccattgcattccatacatgtaatcaacttcgttctggtacacggccctctgttctacatcatttatatccccgacaagaatcttttggaacttatgataatgataaacactactaataaaattaggatcacgaggcactacgcaagcctgaaaaaagaatccaaggtttttaatttcactggaataagaatgtttaccacaaaaatcaaaccaaacttccataccataatctctgcgactcctgatgtactcgctcagaaatttgtggttgttattaaagtcaacagaaacagcaaataacccgacgctatttaatttactgatcctttccatatgtatgagcacaaattcccaggggatcctgagtatatatttatttaacccatatttatggttgaataaattaaatgacttttgtaactcttcaaaaaacatcaatgactcaattatgtggttttcgccttttttccagaagggttcaacgaaataaatatcagtaacatcatctgttttaatgcggttttttgttacatgcacggggtgatatttaaccatgtgatattccgctgtgttattctgtgccgcttaatttcaccactgctgattaaaatccttgttcaacagccgcaatctgccgttgttgttccgtaagaaggataataatgtattaaatcagtaagtacacatcacactttcacactggcagttcgtttgtttcctttatttgctcaagaacaaagctcgatgcagatccactaattgaagaattagttaatattattttctcataaaaactatagtaatcgttcatatctgtaaatactgtatgcattaaataattaaatgatccagaaattcgataaaaggcaataacctcaggcattgactttattttctcagaaatactagcgtattgctcctcagatatgttaatcataataaagacattaagtgaaagacctagtttttctttatccaataaagcgaactgaccaatgataacccccctgtctttaagtttttttaaacgtttgaaacatggtgtgggcgtaagtcccactttatatgcaagttgccataaagtttgtgcacaatctttttggatttctttcaataattctttatctttatcatctaaatacacagtcataggaaagcagaacctcacgcattgattttcataagtgaatagattctctttattaaataaaacaagtatataaagagaactctgatttaaaaaaccatataagaaagatatcaataaaataaataattactgtcagggggtttgtgttcccatcagcattgtcactgtcagcgttccctgatactcaccagaacgcttctctctgatgttaaagggttgtgttgtcagggtaaggggcactggcacacaacgtaccgcctgccgttgcccgggaagtaccaccggacgcgttgctgctttatccacgttatccagactgaactccacgccacgggtgacaggaatacttcgtcccccataattcatactgaccgcataatcaatcgtatcagcagaatcgctctttataacctgaaatcccgtacctgacttattgcttccttctatcttcatctgtaatgaacgggctttcacacctccgtcatacagacacatatccagattagccctgcccgacatttgtgaggcattcatccggtgaagattcaggtccacccggggcgttgctgtaccaaattgcggaaagtaaatagccgcattttcagcaaagtggtctgttacattcagcgtgatatctgtagttgatgtgcctaaaggatcgtctccgccccattgtaaataatccaggactaacgttgctttccatgttccgcttgtaggtatcttcgcaagctcttctgaaggtatcctaagtttcagcgacctaccccattgacatgcagcagcgttcatgttgatgacaccagtataacaggcatcacgaacactgccgagcagtatgagcgtgatttcagcatggctgatttgttctctgaaacgcagacgaatttttgaataagctccaaaagcataccaccataccaaatgtgtttcttcacacgccccctcattttcattcctgtttgaacgacatacccatccccccaacacatttgctacactccattcttgggaccagacaggagtgatgaccgctacattgttcttgtcgtaattcaggtcgacggtaatcgcatcggcgacttgtggcagtgtagcgccagccatcagcaggatggcaattatccttgctggataaacatattttcggatgaaattaataattgctgaccaatgggctgtcatactcgtccacttcattttattactcatagttaacgcctttatctctacgtcaggcttcctgaacggaatggcgcagcaaacctgccacgttcagcaaacggatgacccgcggcgatatttgcaacgcctgtggcagggcatccacgtcacttaattcacaccgcacatcacccactacctgcataacatcccgacgtttatgtactgacatcggacaacgcaggatcctgtttttagacagcagccacaggctggattctttatgctcgctctgcaggctaaatcgcccggaaggtcccaacgacaaaaatggatagttcagtggctgtgcgtccagcagcggtctgccatccttgtccagtacgcggccaacgtacagtcggctcatactggcgctgatgttgtgaaccagcagatgcccgggtgtcaggaagtaacacctgcttccccctcccgcttttacgcctgccataccctgtgaactaacccctgcatcctcaatggtcacctccgtggcgttatagccttccatcagcaacagcgactgctgaccaaaaccgagactgaacggctggctgctgccacgaacgctgactactttcccgctactgccctcgtccccctctgactccacgttcaccgccatgccagaggccggttcaccgtcctgaccacctccccagaacagtccattacgggataacgccagagacgagctgtagccagcggtgagtgaactggcgctgcccgcattacgttgatgggagttactgatagtggcgctcagttcacccatacggccgctcatgcgtccgccgagactcccgctccagctgtcgtcgttataaccggagaaacccaccgacagttcacgatacagatcctgctgccaggatctcacatggttcacattccaggacgtctgtgttttttgattccggctactgtgaatatcggtcccggctgaggtatacctattactgccagtcattgtcggtggttgagaggcatatgacacactgacactcataaacaagccatcatcattcattccgtcatttcgggttcgccatactcccccatgggtattaatattcatgccagccatattaaggctgtacgttgcactagcctgagcagattcgcggtgagaggcagggatgtatgcctgtcgccagaacacattttctttgtcactgttatcatcatatccccggtaaaccggccgaccttctgtcctgctggtactgtatcccagtagggcataccagttccccaccgaaaccgacagggaggcgttcatcgaagtctggcaggtcatactggcatgcactgactgtggatgacgaccactacaggcatcactttccgtatggttacgccacagactcgcggaaaatccgtcgttgtatgtcacctgctcagtgttaccgctcgtgctgtctgtcccatgcagtatcccggcagaaaggtccagcgtgccatccagcactgcatgctgtgaattcagtcgggtttcactgtaccaggcctcatgtgccagagagataccttcggtcagactgatatttttccgcagcccagtttggaatccggcagccatgacagtctcaccgtcataatggctggctttatccccggtatcttccagcccgccctgaataaaccactgggtctgtgcactgaagctattgccccccttactgaagggctgggtctccgttcgccgcagaatcccatcctcatacacccgcaacgccagaggatagcttcccggtggaagagaatgagtatccagggtatgcattcccggggtcaggaactgactccccagcaactcgctgccacgataaatatcaatacgggcatttcgggtaacctgaaccataaccggagtggcattatggtccacctcatggttaacataagcttgggtggtcccggttcgtaatccatcaaaccggctcaggggaagcagactgaacccaaaatccccccccgtggcgctggacagattccgctgatccatccgaccagcctggagataatactgattgccgagatcctgacggacaaacagattgtcaaaccaggcctgactgttattgtaatgttctgactgattccagatagccgcccagtcgcctcccagataacgaccgtcaccaagccccagggcaccgctaccattcagtgtcatattacgactgtggagatcatcactcagatacagcgtctggcggtgaataaatgcgctgacaccctccggggtcggagtcagccagcgtttatcacgtcgttcttcatccggcaaccagtcccggttaagaaacaaagataactgagcgttgttctcatcaaaaataaccgcaacatcctctttatctgttgccacgtaaccacactcgctgctgtcttttgcttctgagacaccacagaccagattgctgttacgtagcaacggacggctgagtgcagccagcgctttttgccgttctgcggccggcaacgcggcaagcccactgctttcaagtaccatcaatggggacatgaactgcacggtgtccggtttaaccaccaccggaaataatcccagtgaatgccctggtagcaacacttcaatttgctcagtctgtccttccagcagagattcaaatccaggagggggaataagagttgcctggctggtaaaactgcacaatcccagtaaataatacatccagaaataacgactcacgtaaagagacctgaattgcaatgaataataagatcaataccggatccggttcaggtacgaacggtgcccccccaaaaccggatcagatgaagagctaataaccagttattagccggcagtgacagcctgtgaaatcaccagactgaccaatccgctgtattcaccggcaggcaggttttgtaaggctgctccagccttctgaccaatatccaggttcagcagagctgaagcatcgccagtttttccgtccgggaacagggttttagcttccagtacagaattggtggtggtcagtgaccgtcctcccagagtcacttccatatcaatggttttggtgggatccaggacgttgataagttgtggagcattcaacagttttacattaaccgacttggtctgatcgttgctgtaaaggcgggtctggagtgatttatggaccaggcccttacccggcatgaaatccagcttcatagtcgacgggagggatgaaccatcggcctgcagcagttcaagtgtactgtcaatattggcagtgacggtaatatccttctgaaccgcagaaacagaaaaagaataaacggtggccaatgccacagctgcggcaataaaagatgttttcatgttcataaaaaataaccttgctttgttgtttattacagtgatatatgtacactcggtatacatccgctccccctgagaataaatgtagggtatagcgtacgctccgtgtgtttttactttccggctgctgttaaatcagcagagattaccggtgaatttgcacccgtacgatattccacacgaaatgcattactttttattccggccggaatatcagcactcccgccgggataaatacttttgcctatattctgccagtggcatgtggtgtcgcagttgccagcccgaataagagaaagccgtgtgtttcccgtattcagcaggtggtgaccgtccgttaccagcgcaggcctggggtctgacggagaaacacgcagcaacaccccccagacaagattcacacttacggatgaattttgctttccgcctgcctgtggatcatcttccagttcaggaacagcctcgaagtatacccgccaggcttcctctctttccggtgcctgagtactgataacacgtattgttttttttgttcccggggaaagagcaaatttctccggggagacaacaagtcctgtctctatatcattccctgctggtacctccttctcctgtggcataccggggtgttcaatacgcatgattcttgttcgaatatattgcacatgatctgatttagaatagacgaacagcgaggtggcctcttcgcggctactattaatttctgccgccatgggataaacgagcatattcgccctggcatgaccacatgcaaacatagcgacacagagaaacaccccgggaagagtatctttaaaattcataccagattttaccgtataaaagtcatctaaattttagtattagcatagacagaaagttatcagcataaagaagcaaattacgattcagtgttaatacattttgtgtggagggcatcatacggaataaaatttttcgctcaatacctctgtttttttcaggaaagaaaaaattagtaaataaaagtccacggatttcattcaccaaaagcgaacgacagatctgtaagaatcgctgaacaattaataacgccgcagtaaaaattttggaaattcttcataagaaagttgttactgtgtacctgacttactcagataaatggaactgtatttccccctccttcaaagcaacaaatacgtaacataacaacgtaggagacagagaatctaaagaaagccctccaggagggagatacaattcagactacaaaaccaaataaaccttaaacaaagccacaaatagactgatcatcatgaggttttacaaaaccaggtaaaaaaaagtaagcaaagtaattaatttagaaaactaaagttacagttagatcagatttacttgctcaatatctgttaaaaatatgatatcagcaaacaaaaacttatatacatcatatggttacgcttgatgtttacacctctccagcaaagtgtaatcaatataatacactatttttagattaaatattagctaaatattccacaaacaacaatataaaacagaacaactcaccatgaaaatacaattcaccttttaaaacataatgttataaaaaataccattcaaattgatgccagtcccttacctgtcaatgttgtttacggttcctttcccccttttgtgcgagtaagcaacatgaatatacaagtcttaacgaccaatgcctctgtcagcccaaaataagtcgacattcctgtgcatggcgctgcagcaggaatagaacggcagacatcagcgcggaatggaatcccggctgaaacaggctcgtctgccatgagtcaaaacgctggagcagttcgacttcagcttccagccaggcatcgatcgtaaggtcgtccgggagttggccggtctggcgttcgtggagcgctgcgagaatgtgatcctgctggggcccccggagtggagaaaacccacctggccgctgcccccggtgtgaaagcggcagatgtgggccatcgggtgttgttcatgccgcaggacaggttggtagacgctgatgaaagcgaagctggaaaaccgcctggagcgccagctacaacaactgagctatgcgcgggggctgatcctggacgaaataggttacctgccaatgaccagtgaggaagccagtctgttcttccgactgctgaaccgacggtatgaaaaagcgagcattatcctgacgtcaaacaaaggcttcgcagactggggagagatgttcggtgataacgtgctggcaacagcgatcctggatcggctactgcatcactcaaccacactgaatatcaaaggagaaagttaccaactgaaggaaaaacgcaaagtcggggcgctgaccaaaagcgcaacgccaatcagtgaagatgaaatggcggaaagcggacagcagaagtgatcaaacagcggatattaaaaatagcgaaaaacgaccataaatcctggcgttgacatcctcaagatttaatatcagaagcttccatgccgccgtatccagacttccagttgtccctggtggcttcagaaataccggcctcccggtagacatctttaacagtccgtccggattcaactgatctaatcacagcgatgatctggtgcgcagtaatacgggctttacgcacagcgatctcctgcgttggcagattgattatgccggatgatctctaaatgtgaatggctcgattatgcgggatacttacagtgcaacctagcgccatttttcagtacactgcaacgtttctggcatgggcttaacttccggctgcccaaaaacagccccgtcctgtttccgggtattatcatttccgtcagtcggcatcatgttttgtattgggcatcgtcaaaagacgactggccggccagtcgcatatctcgatgcctcaattcagtcatcatcatgtgggtttaagtcaggaacgtgtcaaaaccattccaaacgagttaatcatcattcagaaaatcaatttgtgggcgattattccatttatcttcaataaaagacagaaagcgttgaaataaaggagaataatactgacgatgacgccatacaagataaatggggagatctggaactctccattcaggaagtataatttcaagttcattattttttaagtatttagtggcaagccaggccggagtcatgaggttgatacccttcccttctaaaaccaaattaagaacactcaaaagattattggaagataaatgaacattaacagcgccactaatagtgtatgattcctcttgacggaaaagagtaagaggtccggaaagaccatggttgtgaagacccacaataatgtgattttccaaatcgccaggatgtgagatcctgccatattttctgatatatttcggacttgcacaaagaaccaactttaaagggcttatctttcgatacacgagatcctcactttcgattatgccacttttaaaaaccagctcatcaaactccagggatttactaaaaaaatcgctacgctctcgtgaatccaggtagatttttgtatccggatagctagctgtaaattcccatatccacttattggcaagaaactcacagacaatagccggagccgaaaattttatactccctctgataattttatccggatttcgcaattcatccagcaaggactgaaaggaagatgttatccttttcatgcttgcataggctgtctgaccagctccagtcagctctaagtgatgtgaatcgcgccgaagtaaagtaacctcaatagaattctcaaggcgactaagcgatttactgacagcagaaatgctaatatctaattcccgcgcagcccgggaaagattccctacttccgccactttaataaatatcatccaatctcgcataccacgattattgatcagttccatcattatcttccgttgataaaagaaattcttatattaaaggagctatcaacgacttactgatgcgtcattgtgtgcctcaatgtccttgatatcatcataataaaaaacctattggctgcaaaatagcatctgaatcgatcatgattttgcatccatctccggttactaattgaacctgtttaccactcagtgtaaataccctatctcagaagcgatcgtcaaggttgtcgccgaaccagatctcaataataaagtggttcattgtcatgcgcccgttctgcaaaggcattctccttttctgtgacgcagtctggagcgcattaattgtatcgttcacctaacaaagtatcccgtggaaacaagcaaaacatcgccagattattcttacttgagtcccccacccggctcgacattatttgtgaaagcggaggaaacagaacagacggtttaaataagacgcttactcaaaacataaacctatgtgcaggctcctctcatttcgtcacgtcgctgatatccagctttactggtgccaggggaagatatctgcgcaaggcaataattccggcgcaacaacaaccactcccgctgggcctctgtacattcaaaatcgcccatgaccaaaagccagcgggtagaagccctgcgccagtgacctgctgcctccagattctgcgcaaccgggtctatcacggcttccggtgttatcttatttctgctcaaaatcagcaccatcatttgggatatagcctacaacccctgcccgccgatgatgggggaggattcggtatgcagcactttcatcctggtctccggctcagtcagctatccgacgtgcccccttatgccgggccagcagcgaagaaaatccgggcgtggtgtgataaaacaggcgacgtttcagccagcccacattctttcgctcctttgtgttgatacgaccaatacgctgtgaaccgatgactggattgttcatacgcctttctgtggtatacaggtatgtgaaccccagctcttcagccacatgaatataatcagaacaataccagccctcaggccagcacagatgctgactgcagtaacccagcatctccctcatccgcttacgactaagaagaatatcgacacgaagcaaatccgacggattacgggacacaggcttctggtcccagcgtcggtgggtgtgcgtgtgcgaatgaaactcaacaaggccactgaggtgcatctcccggacctctgaccagcgcagcatgacctcatcaacccggccttgtttaaccagcatctgacactcatcatgagagtacaccggttcgcctgcaggaatacgaaccggtccgtcactgatcaaactggtcacaagaaagagatgcgcatgcagattaaactcctgcagcaccggaaaaacctgcaaccagttatccagccagccgccatcaaaagtcagcatgacgcttttacgaggcaatcttgcaccatgataaaaagcttccaccgctgcagcagtaacggttttccagccagattcagccagccatttcatctgcgcccggaacgtacggggagataaggttatctgtccgggtttatcactgacatggtgatacattaataccggtaaatgtcgtgcataagacatatgctttattcctttatgtaaaaaataaattatttttacgcctgaggggacaagaaaaagccccctaaacataaaatcttaaatatcacatatgaatacctgacagataaacaaaccttatactaagggcttataaagccccgctcacaaaagagtgaatcaaacaaatccacaaaacagaaaataataaaggcatcagtgtccgttaaattattttacgaaacataatattcctctccctacaaaaaaagatgaatttcagattttaaaatcaatcagcaattgatttttctgcaatgaagattgctaaccatatttgccttgagtaaattttcaatacatcctcgaacctgatatacagtattcgccttattcactgatacaggaagtatgagtggaacagacggctacgtatcctcctgcgccaatgcacaggccttaaaatccagcgtccaggtgtccgcaggcacttcctgattgccatcaacgaccacactgaaactggcgttatctgcagcggttcttaaaatggcgccacgaccactcaccgtatctggttgccacccctcgccctccaggcgaacctgaatgtgatggcgaggatcctgttgcccgctcagcagcaatacggtaggcgtgttacccgccttttgctcatcgctccatacccgaaacccgctgtgactgccgtgataagtcacccagccttgcgcaagcaccatcccatctggcacatgcccggcccgaaagtaagtacctacacgtagcgttgtctgaagtttttctgcggcgttcgctatcggcaccaagctactggcagcgaccagtaagcttacgctatagataaccgttttcactcgctgtattttcatccacattattctctccttcagaatcggctatctgcagagaccgctcatttgatacaagcccgcgattcccttgtgggcaggtaggtggtagttaacccgacattgctgtgctccccatttcaccgtcagttcgcccttatccgccagaccagtgagataaacctggctatcagtatccaccagatcagcgctgccatcctgcccattgactataacctgcgccccgaaaggaatggcgctaccatcttcccgtttcagcgtcatcagtgccctggccccgatgcgagtgtgaaacttcgcttccaccaccgccccttcggttggcaccacgcgcacatcggtttgtgtgacctctgcgtcatccggtagttgcgacggatcgaggctgactgtattctcctgatagacgctcaggttgcccactgtggtgtcgccacgaaaatccgtcttaacgccaggccaggggccaactggcacccccgaggcccctggcgcttcaaccagcgccactgagccttgcaaaggttgccccagcgtcacaccatgatggtggataactatacctcccgcgatattgactcccatctggcgcatcgcccggctgtagctatagtcaccacctaacaggccgtaagccccattccatgccaagtgcaatgcgctgttattaccaccacctggcggggcatcggcacggtaactctgacgcacctcccaatccagttgctgactgaatgcctctccgttgacccccacttgttgcgtctgaccaccgtgtgatggtgaagtcatctgccaactagcacttacattattccccgtccagcggcttaatggcatactgaaccacaggctggttatgttctctttacggtgcccgccattgcgccacagcgttctgttttgattccagttcaatgacagcgagccccctccgatagaggttccccaactcagtccgtagctgtcatcatgaccggggcgattacgccagtcggtacgggaaccgattaaactcagattgcccaaatgcctcccccatgactgactcaacatcagggtggtacgtgagctcggctgcaaattttcccgccacgaccatagacggttgccattatgtcgataactgtcgagcacatcggatagggtgttatagccctgcgaggcatattgccatctcgtcagaaacaaatttgtccccgtcgcagtcagctggttgctgtaacgcagtcgccaggaggctccttgctgtaccgcttccccctgacgctgactgtgtgtgtcgcttccatcgacagataaactcccccaccgcccgagagatcctcccaaaccaagcgatgcagcttgatagtgcgttgcactctgtataccgccatatgcagtgagattccacggcagaccatacatcaacgtagcctgcgcgatctgcgccttatccgttgcagagtctgacgatcggtatcggcccgccaacaggctgtacttcaaatatccctggtgcagtgctatcgccggggtctgatacggcaccacaaacatttgtgtactgccatcggcctcccacacggtgacatgcagatcaccactactgtctgttaccgacagatcccgcagtgcaaacggtccgggcgccacggtggtgttgtaaatggtgtaaccattctgtttgacctccacccgagcctgcgtgcgggcaatcccacgcactaccggagcaaactgccgctcactgtagggcaccatgttgtcatccgatgccaacatcacaccggtaaatggcacactatcaaatatctccccctgcgaagtcttttgccccagagtcagacgactttttagtgagtacagtccacgctcagcataggtatatgctgcctgccacttccccgacagttgactactccgctgccagctggtcgcattgcggacacgccacgcacctatattgattcccggttgcagttgtacccaggaagagttgtcacgccccaccatatccattttgtaatccgtctgcgttgtcctcgcactgtagttcatcagaaacgccggaataccatcatcccaaagatcttctggagcgatccccttaaattccggacgcaacgccaactgcggaatactcagttgcagttgctgattattgatatccagtaccgctttagcctgtggaatggcggtcagatccgcacactcatctggggtctttgctgctttccacaactgagggtaatcttccgtttttacgccgtagcgtgaaagctgactgaccgtcaaacaagaagccagaaaaggcgttccttgcccatccttttctaatttgaacaccacatcacgggtgtcgacacgtttaccattcaccattacgtccactcgataagtccctggctgttgtaccccctggttaaagagcgacatatcaacccctttcgctgcatcgcccaacattgatgcatcgaatgtgtaagtgtgcgcatttgcgcagtgaaccactcccgcgataaacagtagcaaggcaggttgtttgaacttcatattctgccgctaagcccctggatttatttaaggacgtagtggaacggatgactttcaccaccaaagtcagtaataactctccactcgacatcaccatgggcactacctggcatatttagtgttttgtcagcaaaaggggggatatactcaagccctgtaatgggctttccccctactgtgacggaggctaaattcatgtaaaacggggtggggttctccaccttaagtttgttgcccgcctccacccatcttaaatttcctgcaacatcttccggcgtccccttcacggcatccgggcggaaaatcagcttatcacagacgttgatggacaaattgaggtcaagggtcgcgcccttagcctgtgtatccgacggttcattttcgggtggtaccgcctttacacagacccactgtaaagtctcacgatccgttggcatgtcaccaccagtacggacaatacgcagttgactctgctggttcgcttctaaacgaaatagaggcggcatcaccaaaaaaggagcaggcgaacttttgtctgctgctttgactgaagactgaaccaaaatagggtaattctgcgggttgctcaccgagagcgtggctccaactgtaccagcgtgataaatcacccgtgtagcccccagcttcacgctgaatgatttagtgtttaaacttaatttctgctcagcggcatacactggaggagttatagaattagagacgaataaaacagccgccattacaccaaaactaataattttcatattacaagttataaaaaaatgtatgacttgatatttattgcgctttaataaagcgcaataaaagttgtttactattaagcttgatactccgctatgtgtatcgtcactggataagtatcagcctttaccgtttgtgatccagacaatttcacagcgactttgtctgtcatgttatatatccaccacttatgcgaagcaccatccactaatgaaccttttgagccacaggctacccccccaaaggtaattttaatggtattaccacttttaccaattaccgtccacacatcgctgtcgttgcccactgttttcaggtttagaataatctcccgttaccacgtattgtttgctcgaaccgcttgccgaaagtatagcaatagcctcatcacccttatgaggccctgccaccaagccagacactggagtaagctgtgcttgtagttgtccaggattgctgaagtttacatccgccgacacgccagtgcttgtattcggcacgagcgagccagcataacaactagcagccataatgctcaatgcgcttgcgataattaaatcttttatgtttttcatcggaaatccaccttttcaaaatcccccagcacatcaagaatgaataatgtcataccaaaattcaccgtacagaaaagcctgtggctgggaatactttaagacttaataatacttaatagaagttgcttactattaagcttgatatgccgctatgtttacagtcattgggaagacatcagctgggacattctgatctccagctagtttaacaccaagtttgtcgttaatatcatatatgatccactgatgcccattgtaatttacattcccctttggtgaggttgtctcaccatagaagtacactttgattcctttgccagtatttttaccatataaagtccatgtatcgccattcatgacattctttgccttaaaatccgctgcgatcgcgaattgtttagcagcaacagaactaactgcaatagtcgcaatctccgtattagacttaatcaccccagcctttaagcccgccactggagcaaatgttacgctcaactgctggggagaggcaaagccaatatccactgaactttgttgctctgagcccaccacgattgaaccagcataacaactagcagttatcatgctcaacacgcttgcgataattaatttttttatgtttttcattgaaaaaatacctctttaaaactaagttaaaatcgcacgtccagaatgttatgatgtcataacaaattttaccatatgggaaaatccctggctggtaataacaacttgtacttattggtatttgttaccaattcaaacaagtaatgtcataaaaatctatatatcagagcacctcttaatctgaaaaaaattgcgttattgccaatataaccagcattgatgttaacatcgtattgtcagggtggaatagaatgccagtcaaaaagcaattataccttccatttacattcaagtgataacattacaatgaaacccaccacactgggtgtgggaaacttatcttcgaagagaggataattatcaggcatcgttgcaacattgtttatatttaaacatacatctcctaactcgacggtaagattattagttaacttttcctcgcagggaagatctttaatggaaaatcttgttttccgaaacggaaaagcaattataacgctccaacgagagtctcaacactaagagctgactgacacaggccagactgattatacaggcatgaaaaagctctccccttcctttcagttcttgctggattatgcaaacgtcgcaccacctccccgtgaacatggcacattaatttgaagcaactctcatccggtatcgcttttcagtgcagcgaaattcatcgcaggtgcccctgtaaatagacccgttttagttccatgcatttttaagattccggccagataacgttattggcggtattcctccggtatcatattgttccgcgattcatgtggacgttcgcagttatattctgataaccctttatccgtaatttcccgcacctcattcagcgttctgaacagataagaattgagtatttctgtacggtatgtccggttaaaacgctcgatgaaaacgtttttcttcggcttacccggctggataaacgccagctttactacatgtttctttgcccattcagccagtgccagcgagataaattccggtcccttatccatacgcagcatggccggataaccgaggttgctgtaatcctgtcgagtacacggaccactcgcagagctggcagattcagatcgatttcaatcgacaacgcttcacgattacagtcatcaacaacattgaacgtgcgaaaacgacgcccataaaccagctctggttcagcgcttccggcgtgaccagtggcgagggattgcgtaccggcagccgttgtttacccttacggcgaaaattcagcttgagcagacagtaaatacggtggagccttttgtgattccacgcgtatccctgccgccgtatccagacctccagttatccctggtggcttcagaaataccggcctcccggtagacatctttaacagtccgtccggattcgactgatctaatcacaacgatgatctggtgcgcagtaatacgggctttacgcatagcgatctcctgcgttggcagattgattatgtcggatgatctctaaatgtgaatggctcgattatgcgggatacttacatactcacgcgttgagagactttcagttcgtttgtacggtgaatggatgccgcaggcggggtttattaacgggatgcccgtcaaggtgcgggtaatgagggattgcatcgtgatcacgccgcagcatacccgcggactctttgtctgtattgaagggatgggcgtgacttttattaatcaaaagaaggtgaaagcgtggctaaaaacctttccgggggcgctgaacgataccggggatattccggtgattaagcggagcaggctcgaaggcgggatttgacagggggttaaataataaaaaagccgggaagagttaatttctttcccggctttattaacacctaatgtattactggtatctattatacaattctatttcagccagaacatattcactgaaaacatatttagttttctttatctccttcccttctgtatagcaatatacagaagggtcatcatctctttcaataaaaaacaacgcagaatatccttgatgcaataaaaaagaatacattccatctggaatgcttatattattttcttgcatcaactcaactgtatacttatttatatcatttatatctttaaaaagaagatcagtcccttccttaaagtcaccagattcgacacccaaaagagataaaaataatttataagactttggtaattctccatagttttcttccagatacagtatatcctctgtagaacaccccttgacagtcatgttttttgacgttatcgatgcaattaacttcttaatttcaatcaaaaaagctcgctgttccatattaccctccccatgtcacattaacttcaatattaggatacattgctttgaattgagttataacctctgaacatgaggggcatacttttaattccgagtatagatcaatacgaccttttgccgttgttggaaatttattggctatatgttcaaatattttaacttcagaatcgaaagccctgtcatgccccacttcgaaggtagtgaactttcgacttccgtctgctggagtatgtaaaaatggtgaattattcgtattcatgccactaagtgcatcagccgttcctgtttgaccattaatattataattggatgttgcaatatttcgttttccacctacctagccagtgcttctataattcctggccctttctgccggagaacctttaccagcaaattttttacataaacctagcggatctatataacttagcggattaggcgcatattggtagaggtttattccacccgctaaccctatcggatcgcccgatataaacttcccgatatccggatcataaaatctgtacaaattgtaatgcagccccgtttccctgtccagatattgcccctggaaacgcaggttctgctgtacgggccgggtttctttttcatgcgtcaggttcccccatacctgatagcccgcttcccagacaatattgcccccgccgtccgtcatctcctccggcgcgccgtttacgtccgtatggtaatacagcacctcatccgcttcgcccggcgccgccctgtccacccgcgccagcggctcgtggctcccccggtcgctgtagatatacaggctgctgcttcttcccagcctgcactcctgtgccagccgcattccgtcccataaaaacgtcgtccggttatacggctttccttccgcgtccagctcgtgcttctccacccgcctgcccggcgcgtcgtacacgtacccgtaacgccgtacggtgcccccccgggtgaccgccacttccgtcagccggtgctccgcgtcccagcggtagtgctgcgtgccgttgcggccccgcttttccaccacccggccatattcatcgtaacggtaatgcagcccgcgatatgacgttatccggttgaacggcaccacgctgcctgcacccgcctgcgcggtctctccctgccgcctgtccagcaggttcgccgccgcgtcgtactgccagctgtccaggtatgcctcattccggcacgccgtgatgcgccccgtcgtgtcgtaaaaataatccgtcaccccctgccggctgtgccgctttttcagcagctcatcctggccgctgtacgcatattcccggtcaataaacgtctccggcaccacaccgcgcattcctttacaggtcagtttccgcgttaaccggcccgtccggtcgtacatccgccgcatgtccagccgcccctggctccgctgcacctcacggtgcaggtggtcgcgcgtgaactcgctgatgacatcacgccccaggttgatttgctggagatgtccgctcccgtagtacaggtaccgcagcgtccgcccgtccggcatctgcgtttctgtgcggttgccctgaacatcgtaccggtgctgcagcacgccctgcgccgtctcctcgctcagcaggttacccgcactgtcgtagctgaaccggataacttccggctctccgccttccgccgcatcatgccgcctgcggcggatttccagcagacggtccgccgcgtcgtaccggtattccgtgcgcgtctccggcgtgattttcgccgtcagcctccccgccgcatcacgctccagaccgtggcggatttctcccccgcgctccccgccgtatatcactgccgtcaccgcattcagcgcgttatacccgtatgcccggcggctgccgccggggtccgtctgttccgtcacccggtccagaacatcgtaccggaaccggtagctttccccgttctcgttcgtgagcgtggtcagccgcccgtaagcgtcgtactcatacgccgtcctgcgacccgtcgcatccgtctgcctgcgcacccgcccctggccgtcccgctgccagcgtgttatttgccccgccgggctcgtatatttcaccagccgtcccgccgcatccggctggtaacgctccgtacgcccgtccgcgaacatgacctccgtcagatgtccgttgccgtcatagctgtaacgcgtactgttactctccgcgtccgtcaccctttccagccgcgtgcgttcatcataaaaccatgccgtctgcgagccagaacagtccgtgtggcgcataagctgtccgtcttcgttccactgcaggtatttatctccgccccgcgcgtcggttatccgcaccacctggccgtgccggtcatacccgtataccgtgcgctggtgcagcgggtcgctgaccgcctgcaggttgccccgctcatcatactcataacgccacgccacccccgcggcatccacctccgtttccggctggtgccacaccgggtgccactgcgtctgctcaacccggcccagcgggtcatgcgtctccgtcaggtggccgagacggtcatagacataacgccatttgccaccctgcgcgtccgtcatccccagcagtaaccgctcttcatcgctccagcggaaagtggtcatctgcccggcctcgtcccggtacgccgtcaccaggccctgcgcatcccaccagtggcagcgcgtacgccccatgctatccgtcacgcacagcgaacgttctgccagattccagtccagacggtactgctcgccgctgtccgtatgatggcccgtcacccgccacgccgcatcgtccgggccttcaaaccacgcccaggtgtagtaataccgttcgccgcccggctcccggtgcatcgtcatgcagtcgttgtcgtcgtacgcaaactcgcgctgatactgtgccggattttacccactgtgagttctattcacgggttgagggacgttcagttcgtttatgcggtgaatggatgccgcaggccgggtttattaacggagtgcccgttaaaattcgggtgatgaaagactgcatcgtgatcacgctgcaaaatacccgtgaactgttgggctgtattgaagggatgggcgtgacctatatcaaccagcgaaacgttaaagcatggctgaaagattttcccggtgcgctgaatgacaccggggatattccggtgatgagtcgggatcttcagtgtattactaccaattgccggtttgctcactaacaacagaaaaaacaacatcgcggtcatcaaatatcccgtgtcagtctatggattcatttccatttcagtgtcatcaacatgcagcccgacaatcccggcgtcctgtattgcatcgatcagtctgtcagaaaaaaatagccctttcccctgaaaaccgatagtatcaacatcgtaaaatacatctggatatatttttctgggtttaacagaaaaatctgtatttataaatgcgtcgtatgattttaaattaaattcgcttcttttttttgtatcaaaaaatatggatttatttaaatcaattctttcttgtggtatcattggaaaaccaatcaaaaaatattctgtattgaatgtgttgattctggttggtattttattaactggaggcaggttaaagttattcatgatatcaaataattttttagatatcagaaaatcgagtccaagtttgaatggacaaaaatcaatcatatctatttcttttatttttttccttacagggaaaaaacatatttcttgaattttattaacatcaatgcatttaaagtcatcaatcatcactctattataatccttgctatttttcaaaaaaaagccttcgaaatattttttatcttctttacttttaaaggaaagactatcttttatctctaccgagtagactccattaacatttccagtaacttcggtatcataagatactcttatttttttatatttcattattagcaacctcctttaaaatagtcattcagatttttaccagatgcttttgcagcattaattttagacctcaactcatcctgcaaatttcttagctcagttaaacttaattttttattttttataagttcactaattttatcttttacataagcactataggcaggatgattaccatggaaaggtttatccagatcaattaagtttgttacatccattgctttcttcgtgacgttttgcacatatccggtgactttttttaaatccgttttaaaagttttccaaacctcttgcggaattatatggtgtaaatccagtcccagaggatctatccatgtcagtggattagggcagtacgcatacaggtttaacccgccccttaacccaatcggatcctgactgacgaaccgtccacactccggtgcataatatctgaacagattgtaatgcagccccgtctcgtcgtcaaaatactgccccggcagccgcagcggctggtgaaagtacgccccgctgttgctgatgtccgccgcattctctccaaaccccctgatataccccgcccacaccagcgttccgtccgccgccgtcacctcctgcggcgtgcccgtcacgtccgtgtggtaataccacacctgcctgctttctccccgccccgtcacgctcgccaccggcgtgtacggctgttccgcatcgtacacatatgtccgccagccctgctgctgcacgttctcctgcaacagcctgaacccctcccacacaaagtccgtccggctccgcgccgtatggcccgtgtgccgcccgtacgtcgccttgcggattcgcctccccagcgcatcgtagccgtagtgcgtctccgtgttgccgctgatgacccgcgtcagctgcccctgcgcgttccactccagttgctggtcgcgccgcgtggtcagctcgccccactcgttataaccgtaacggtcacgaccacagcccggcagccggttgttcatcaccggaccctgcccttcgttatccagcaggttgcccgccttatcgtaataataacggtcatggtcatacatctgacctgagcgcccggtcaggtaaccgcttctgtcatagctgtacaccacgctgccacgcaggccgtcgtcaatcgtgcccacctcgccgtggttgttccagtaatagtccctcgacgtcacgcagccctgccgcgccgggcgctggccgggaagaacaggggcactgccgggcgccaggctgcgctgccagctcagcagcccgtcgtcgtcatagccgctgtacgtcgcaagctgcccctgcgtgcgcattatctgacggtgcaggctgtcgcgctcatactcgctcaccgtcaggccgtccagcgccgtctgtaacagatgcccgctcccgtaatacagatgcgtcaggtgctgcccgtccggcagcgtgatgtccgtcgggttgcccagcgcgtcgcgctgataacatatgctaccgttccccgcgtgctccgccgtcagccagccgctgcggtcatactcaaaacgcaccgtgtcggcctgcatccggtgctgctgttgccccgcctccgtgggcgtgagcgtcactgccgttatctggtccagccggttgtagctgaacgtccgctggccgtgttcattctccgtccgtaacagacggcccagcgcatcccgctgctgcgtctcccgccgcacgccgccctgcgtacccgtggtctgtatcgccgtcagataaccgctgtcgtccaggataaaagtacggctcagtccgtccgggcgcacctcacgcatcagcctgccgtccgcatcgtgactgaaccggtactgcgccccgttgccgttggtcagcgcggtcacccggccttccggcgtgtactgccagcgcgtctcgcgcttctcctcatccgtgtgcgccgccagcagaccgcgcggcgtataccgccagctctccacgctccccgtgatgcgccggtggctgctcatcagccccagcgcattccaggtatacctgtcctgctgtttccccggtgagttcaccgtctccggcaacccaagtcggttgtagctgatgcgtaccaccttcccttccgcgtccgtcacccgcgtcaggttgccgtcctcatcgtggtcatatcctgtgctacgccctgaacagtcggtgtaccgcgtcatctgcccccggctgtcgaacgccgtcaccaccgtgccgcccgccgcatccgtccggctgcacatctgcccctgttcatcgtaagcgtactgcgtcacccgcccttccgggtccgtctcctgcactggctggccgtgggcgttgtactgcgttttccagacagcgtcatcgtccagcgccgtgcgcgtgatttcgtcgaactcgccgttccactgcgtctgcgtcacccggccttccggatctgtcgtcttcaccacccggttctggatgtcatattcatacgccaccgtgcgaccgccgggcagcccaatgttgacagggaagtggtcttcgttgtacgtgaagcggtacattccaccgcccggcgtccggtgcgcggtgatatacgtctccctgtcgtaccaccactgccatgactccccctgcctgccggtgacggtggtggtgcctgcggcaaaatcatagtcaaagcggtaatgttcaccgtcactggtgtcgtgctccgtcacgcgcggcgcgccgtcgagttcctgccagcggtagcggcaggtgaaccccgccgcattgctgtgcgccgtcatcagcccgttttcataagcaaactgccgcacctgcgttcccgcccggttcaccacgccggtcagttgaccgttatcgtcataccggtactccaccagattgccacaggtgccgccctgcaccagttcaattcgcgacagccgctcccctgccggggtctgtgtgcggtgcagtaacaggtgatgcccgctgctggaggctatccgtaccagtctgcctccttcgtgcccgaagacaatgcgctggcggtgcggcgtctccataaacagcaggtatgccatgccgtcactgtcaaaatcaccaaatacgtaatagctgcgatcggtgtaatgcagcacgtaacgcccgtcatgcaggcggctgaggtataactgttctttcgggccaaatatctggtggccgggcgtcagcatcattttcgggtaacgcagttcccgcccctgtacgccggtcagcgtgatgtgttcatcgtcctcgcgcaggctggtttcccagttcagccgccagccctgtcccaacagtcccacggtttccaggtggctggcgtaaaaacgcgagcaggtgaccggcaggcgaccgggcagggtgaagtccgtttccggcagcaggattttctgcccggtggtcacatccaccggattgctgaacagcccgctgatagcctcactcacggccatcccggtaagctccccgccgataaacttagcggcacatttagtgccaaatttcgtccccagctttgccgcctgccgccacgccccggccagcccgccgagcagactcgccacgacaaacaatacatccaccaccttgcgcagccagtccggaatttcagaactgatttccagtaccgtctgtgtgccgccgccgagaaacacattcggcgaaccgtcttcaaccaccgcatcgcattcggtatggtcatccttacgggcggcaggctggctgttgatgtaaatattgccggaaccctgggcgatgcgtttttctgcgatatggttatcgcatttcaccgtactcagtaccgcgcgcgccgccgggcgactgttggtgctgacattctccgaaccggtgaggatttttcctgccgtgtggtggatggagcgcccgatggcctcgcccagttgcaataccccggaggctatttgatcggccataaaacccagaatcagcccggcaagaaaaccgcagctaaagaaggcaaaggcggcaagcgcgataatggcgatgccgatgatagcgccgataagaaacccggcgagcgcactggtgtggtagatagggtcatccacacgggctgcttcatacatggtcacacctccgtgtgattattcgtttttatccggctgaaagcctgccagccaggtgttccagagtaggtctgctttatcatcaaaaggacggggactggtcagggtgaagactagtaccttgccaggggttgcaataaacccggcctgacgctggtacacttccgttttcccggatttatgggtggcggcaatttgttcccccatcagggcatcattgcccgttcctgcctgtgcaggcgctcgcgacaatacccggtgctgaccgagattttttttcatcagcgcaatctggcggtcaatataggcgggcaggtcttcatcaggttttagcgtatcgcgggaaatattcaggctgggcgatgttcgttcattgccctccaggataaaaatattgacgctgcgatccgtaaatgtttcaggcaggacaaaacacccttcctgtatgcggtatggtcgatccatgagaactccaggtttaattcagatcactcagaggtgggaaggggggcaatatcatcggcggttacggctgtgccgccatccgggttcatatcaatacctttaccaatcagttgcatgacatcgctggtatgcaacatcagttgcttgccacaaaactcaatggagccgtccttatgtaaaacaagcgccgcattgccgcagcgaagtgtgaattgatcgccaacatctaaacgataagtggtgccgatattgatcgtctgcgccagttttacggaaaggccgtcattcttcgttaccgtggtgtttctgtcttcaccaatactgttggtttcatttttaataatggttttagtgcgatccaccataaccgtatgcgtttcattattcttcaccgtggtgttgagatctttttccgcgtggaacttcacttcctccgcgcccgttttgtcgtcaaaacgcagcatgttgccgttcgttggcccgccatacagcgagtggctgaagatcccgctctgcgacgccattcccggcagtccccacggcggcatggtgtcctggttgtaggtacgccccacgatgatcggcagatccggatcgccgtttttgaaatccaccagcacttcctggccgatacgcgggatctggatcatcccgaagcctttgcccgcccatgggtagctgacgcgtatccagcaggagctgttttcatccattttgccgtagcgatcccagccaaactgtacctttacccgcccgtactgatccgtccagatttcctggcccgccgggccggtgacgatggcgctctgcggccctttggtgtggggtttgctcaccgtccgctgcgggcggaacacctcacgggtcgggtgcagttcaaaacgggtggaaaaggtaaagtgctggtcctgcccgctgtgctgcgcgttgtcctgtacaaacagcaaggtctgcatcagcaggtattcctgattgacttcggcggtgggatagttttccagcgtgaaggtataaccggtcatgagtgtgcggatattccctccccccagcacccgactgccggggctgcgctgcgcttccatacgaatgcgcgtcagcatctcgccttcactcttgtcgaagtagtctcccggccactcataatgctcgtaggtggcatgaccggtttcacgcgggtttgccacggtgtttgccagcaatgaacgtggcttcgtaaaatcgaaatcatccagcacccactggccagtccgcagactctcgtttgccgtgatagtgtggataaactccttgtccagcttcagcccttcctggtgccactcgaccagcggcgagtccggacatgctttgtgggcgctgatggcatccgccagcaccagcgtgtggctgtcctcgctgtgctcaaaccaccagtagatgccccactcctgcatcagtcgctgaagaaaatcaaaatcagtttcaccgtactgcacctgccaggtgcgtaccgggtagctttccaccagccgcttttccaccgggtaggggtattccgccagaacctcatccagaatatccaccacggttttattctggaatgctttgtagtcgctggtatgggtcagcagttttacccacggctccatacgcagctcataggtaaccgaacgcccttcatggcccaccacccgcgccgccgtgaccagcccgctgatatgtcgtttaccgccaccatccagttcgatgttgacgcacagatctttgcccaccatcggtttgagcggcaggttggccgccggggagacatagcccagattcagggtgtcgggcgtttttagctgtaccacataactgaacagttcacttaatgtttcgccgccgtccaggctggcgaacagtaatgcgcccggcggtacggcgctgccgctgaccgtcacattatgcgcccccggcccgcctgcaacagcagagacgatggccgataccgcatcctgcgccatacctgcagcggcggcagcctgcgccgctgccaccgcggctttcaccagtcctgatggctccggcaatgcgccaaacagcgatcccgcagcctgttccacggcggcttctgccgcatctgccacgcttccggcgactgaatctgcggtgacaccgccactttctccggttatcggcggcgtggttgtcgtcagccctcccataccggatttattatttgtggatacaaaactcatggtagtgactcctttaataccggattaaaataaatagactcaccgtcaggaaacagtgccccgcactttataatgcaaccagcctgttatatttaaatatttaccagaagaacagggtatattgctgacaagagccatgaaaataaaaacacaaaaattagcacataacataaatactgaattacataaataaggaaatgaatataacaatattatgattttatttttattacgcttaccagattcgcattgcattttataaaaatttgattaataaccagcacaccgccagtcatatactttatcattggtgctcgttacttatctggccaccattgtaatcattgtcaaccacagcacgttcagacacgataatttgatccggttttaacggtattattgttttgttccaccattcgtttgctgaccagaaacatacttaacattaaccgtaaatatcttttcaccattttctttttacgtctcctgtttcagaatacggaaaaacaccggttccacttcaatacaaccatggctgtaacctttggtggaatcatggatataaaaaccaccccgcttgcccccacaggcttttcgggtcttctcatccgctgattccagccggatacggttatatccccagttcgcccagtatatctcacatgttccggcagcctggcctcgcggaatggtactccagccccatgatggtcccagatcacaatccgcagcatttcttatcggtgcctccccctgaaactgaataaacaatttataattcccttccggtatcgccgcatccggcacacactgtttatctggccactgtaaatccggtaaccccgtggtcgccttaaatatcccgataccaggccatgtcagcttttgcccgtcaaaagtcagtcttactgccatcatcttctccctgactattctgtgtattacagcggtggtgtacaacgtatcattagcgccagcttctgatcccgtacagactggttatccaccgataatacaaagctgaaaggataacgtccctgcatcttcgccagtgagatattcccctcctgaagggaatatgcacttccgcgtccgtaaccctcaacatcctgcgccagtaagctggtatagctgattaatgctgagaaacagccacattcaccggtactttttttcagtgtgaccgttgttttcagaatggtaaggttatccatttcctgacgatgaacgggatggatatccacacactccgccagcgggttatcaatgtttacatctgttccgccccaggcaaatacgggcaggaacattcctgcacaggcagacataaacagaacctctacagcgtactttttcacagcatctgacctctatttttttcatccaccagccgcagtgcatccatataccgcccttcactgttctgctgccagaaccagccttgccctggcaggtaacgtatgcccggtagatccaactatcccactattcatctgtacagcccagcccccggcgctgtaccacttcactggcaaatgtcgcgccagtttttttcattatttcttgttgtattttttgcaactgcggaaatataattctctcacatttatttatttcccatatatcaccagtttgagaacttactgaaaacagcccccaataatctattgctccggcagtcggtgtatcatagccaaggctaaaatcataatatcccggatggggaggatttccgtgtttatcctgcaaatcaccgtcaacaaaaacgccatccagcgataaatcatatttttgatatttaagtgcaataatgagtagtttttctgcctgtgctttcgtcattccaccgcgatttatatctgacaaattaaattcagatacaaccgcttgggcataacagaactcagatataaagagaaaaaaaacaagcattattttacggggcatgctattctccgcccgaccataataattattccagcagttatcctggcgtaattatccgtaccaccagtaatatgagatcctgaattaaacccagcagctaccagagcttcagagaagaccagagcatcttttttcccccgaacagcgtcaccatacttgacagcaaaagatcgcgcacaaactgaaaacgaagaaaaaatagccacccaagttttgttactatcctttggatgaacccgacctgactgaaatgatgcaggagcctggagagaaaagtaattattatatcccctggcaatacgacctgtaccatattgactttcggcagcagcaagacccagtatattctctaccggtacgtcaagctcttttgcaattatctcacaaaccttcatgtgctcctggacaaatcttaccgcacccacgttattacacgctttatcataattacccatttcttcattccttagcagatgtttttaaaaccaccatgttcattatttctccgccagtcgcagcgcatccacataccgcccttcactgttctgctgccagaaccagccttgccccggtgttgcctgccccagcgtcttgcccggccagcccggccacggcagataacgcacgcccggcagttctactaccggtgcttcatccggcagcccggtcagttcccagctgcgctgcgatgtacgtcgtaacccgcgcagccactgcgcccaccacggccccggctgccacatcgcccatagctggtccacctgctccgtcagccgcccgcgccgcatcgtgtccggcgtgatatgctgcgccgccagcctcgccagccagtacagccagccctgcgtctcctgcaaactctcgtccagccactcccgaccgcagcgctggtaaatcaccagcggccacgggcgtcccacgctatcccgtgacgccatcagcactccggtcagccagtcagtcgtcccacccatcggcaaaaatcccggcgacatcacaaagctccacggcagcggatggtgttccggcgcgggcatatcatgttcgccacgcggcgacaggtgcatccagccgtcacgctcttcatcggtcgtctggccttccggcaacacgatatgccgcccgctgcccacccatgtctggcggttcagccagtcctgccatattcgtccctcttcagcgcccacccgccagcgcacatagtcgcgctggtccggcaacctgccgaacatcgccggggctgataccaccgctggccggcgcattacaacgccctcgccggacaactgaagttctgcaacagctcccggctgaccgggttaaaatcccgcccggcagtgatttccagcaccacccggcgaccgtcaaaatcatattccaccaattggcgcccccgcaccgccgtttcctgtacctttccggcgtccagcagatgaaacagcgcccacggcccgccggtcagtagcgttgaggtgtcctggcgaatacgcgggctggcggtgatttccgccatcgagccgttgcgcggtcccggccacgtcactttcaggggccggtccggaccatgggcgtagcgcagcacctgaccatcgatatcaatcaccagttccgtgatggccgggtccatatccaccacgctaatctgcatcgaccaggaaaattttttcctgccctcgctgttaaaaaacacgctgcggatctgcttcgcctgctgaaacggcgttaaatccggcccctgcaatgtcatgttgccttcggtcggtttgtagcgccacgggtcgctggcggtgtccgccagcggagccagttgtttgctccagaaagcatccagtacgccgccgctggcgaagatgcggttaaagtcctcggcgctgacctcctgcggactatcggcgaacggatagcgcccgtcgatggcgtcacggcagtcgtcgcccatcatcgcctccatctgggtgttgagcacatcgccggtcccggcgttgattttgcgcgttccctgcttcgtcagatccagcaggatgtttttcagcggcgcaggcagtttcgccgcctccagttgcaacttgtctgcggcagtaatgcgcgctggcaacgtccccgccgccagcgcgctgtcagcaatggccagttgggtgtaatactcgttgagcatggtcagcagcgaagcgatctgcatcgtcccaccgccgctctgtccgccgtccgtccgcccggcaatgacctcgcgcagcgcggcgaaacggtcatccaccagcgttttttccagccgctcttccgggtgaatatcctggaacagttttgccgtctgtaccactttccccgcgttaccggacgcgcgctgcgccagttgtttctgtctggcctgcgggtccggcggcggcaccagcgtggtctgctccaccaccgcttttcccagccgcatcagcggtgagtccggcgacgccagggtgcgcagcacctgtaaatcataggccaggccggaactgccctcttccccggcactgttgatactatggatactgtccagaaaatcctgccagcggcgggcatattccgtcaggtacaaacggcggacttcgcgggcgacagactgctcctgccccggtatctggctgcgcaggctgtcagtcagcttttttggcgtactctcccggcccatcacccagccatcgttcgccgtcgccacaaattccggtaatcgtttgtcgaacagctcccggtaaccttcacgggtaaaaatacccggcacgccccgatccagcggcgcgccgttgctacgcacaaacaccgttcccgcatccgcgccgacggcgcgtaccagcgtgaactcctgcggcgcttcgctctccatcaccgccagcgcccgcgcatagatacgctcggtactggtgtgaccgtcgaggaatgcccgcgcctggcggatcagcgcctcatctttctcatacggtgaatgcaccacccggctgccgtcaaacagcgcttcgatatgcgtcagcacggcggcgcgcccgccaaacccggccacgctgtcgctgttccccagatcgttaatcacccacgactggatctccgccgcgttgtatttatcttcgtgatctttatccagattcagtagcagatagatgcgcagggcatcatacgcagctttactgtcctgacgggcaatggcgtctgccagcacatactccatccgtttcaccagcggcggcagcagcagttgatccagcagacggttgtacagcgacgccacgctgtcggttaccggcggtacgctgtacaggccgtagcgccaggtcagcggcggcgcgtccgggtccagtcggccaggcggacagttcccttgcgctgtccagcagtgccgggacgggagccatcgccggtttaccggtgtaggctttcacatcaccgtccagccgggtcgcgcgggcgctgatttcattcagatagtcgccgttggtctgctggctggtctgcatcccctgccacaacaggaatgccagcaccagtaccagcaggtgcccgccgaggcgcagcaggcggtaacgccaggcccactggaggtttggctccaccaggtgcgcttcacggaaaataaactgtgtcagcaggtcatgcagaaagtagctgcggttgccgtccggcagagcgtgtgggagagaggcggatgattcgccacgggtggtttttatcgcccggacaaagcgctgccagatactcaactggtcggccacggcgtcggcctgcgcctgcgcggcgctggtgaaaaacaccccgcgcagcgtgttattcagttgcgtggcatcgaattttgaatcgaggaagatctgttcaatagcctccagcaacggctcgccgagggcggcgaactcacgcgggaaggtatacagccgctggcggcttttaaggtcgtactcttcctgtaaccgggtatccagtccctgatccagccgcagcgtcaggcgcgccagctcctgcgcgcaggcggcatgcagcgcctgcgggtcgcccgtttttcgcctgcggctgtacggcaacgtaaagccccagatttgtgcgcgaagatggctggtcagcgtacgaaaatactcgctgaaccccggcaacaaatccattttagtgaccaccagatagaccggaaagcgaatccccagggtctcgcgcagttctgccagtcgcgcccgcagagcggcgcaggccgccaggcgttccgccggtggctgtgcggttaaatccgctacgtttagcgtcaggatcacgccgttaagcggcgcgccggggcgatgtttacgcagcagaccgagaaagccctgccactctccggcgttgcgctgcgcggcgctcgcttcgccgccgtcatcgtggcgcgcgtagcgtccagcggtatcaatcaacaccgcttcgttggtaaaccaccagtcgcagtgtagcgtgccgccacccggcactgtcaggatgcgcgaggtctgctccatttgctccgccagcgggaactgcaatccggtgttcagcagggccgtggttttgccgtcgccgggactgccgaccaccatgaaccacggcagctcatacagaaagcgttttccctcgaagattttacgccagccaggcatatccacccgcaactgccgcagctgccggatggcctgcgtgacaatatggttgacggtgcgcaggtcggctttgatctcgcctgccaccggtacctcttccccgcgcggatgcaggaagcgacgcagcagttgttcatccatacgcagcgcacgccacagccggtacaggccgtacagcgcgtacatcagcaggatgaaaccaatcagggtcaggcggacccacagcggcgcaaacggatggacatcgcccagggccagcagcggtgtgacgaagccaatcgccaggcacaggacactgatgccgatgatactcatcgaccagttgaccagccacagtaccagcaacatcagcaacagggcaatggtcaccacccggctgcccacggaggccagcgggcgcagggtatcaaatgacaccagcggcccgacaaaccagaccagcagcgccagaaccagaacgcccacaatcgccagcgcgcgccgggaaaaaagcagactgagaaatttttgcattatatttcgactcgccacccaataatcagtaacagcaaagcgctgagaccagaaaacaatctcccgttaccgtaattaatttaaaaaaaatatagaaagctcttgaaaaataataaatccggaagtcaaaaatacttcacggaccctgaacgtgtgttttcgtctctcaacccttcagaattccggcattattacattccatttcactcaaatcacacgaacggaatttcagaattttagcgtaattcccagaaccaaatttgcttacaggaaaaataacagtgtgaatgacatactgccccggcactggtcggctcaatcagatcgatatgactaccactcccaccattatatccatcaattttccagaagaagaccacaccttttttattacccagttctgtctgaaatttagtcggatcacgccagaccgcaggtttaccgaaaacagttgcctgcgaaagtatatctgccagatttttagcgcctgtttcaatgctccggcccttccacttgccctcttttatcgggagaagacggcctttaaacttcacacctgatttaattaatgccacgctcatacgggccgcacaggtattttcaaactgagcaccaagtttcccctggtcataaccaatgcctgcatagaaatctttcgaatcaacaaaatcaggactttcaaaagatgatgaattatgattagactttagcactgagaataaaggtttcattttttaactcctgtatcacatgaatatttaattaatttatccataataagctcagccgcgcgagaattaagttctttatgtgttttatttttaagaaaacatagacaatttcatttaatgttagcgtcttaaataaatcgtatccacaccatagttttttctccgttgcatcctccacgccaagcagatagatacccgccctgagtttatccagttgattaccagatacccaaaatttaaaaaagtcattacctgaaagattaagcgcatccggcgtcagggataacacaggagatgaccgggaagcaatttttacggagggttcagtcccctgacaggggaaatttttaactaatgcttcctctatcagcaccgaagctcttgcatcaggctttttcacagagtaccgatcaagccaggccagcacagtatggtttattgttatactgtcaacctgaccatatccacaccacgtcttaccttctgtggcatccgctacccccaacacatacatcagtgtattatctttttcctgtaagttatcactggcataaaaccccagaaaatcccgtatactgaggttgacattatcgggggaaattaatcctgcgttaatcagggacccggcaaaaacgccaccgggtaacaggcaacataagatgatcaaaaaaacacggatagatcgttttatgtgatatgtcgctgagatccgataataatcccccgtcacgccacatattgccgaatgatgagacacatcataggtcgatttttttatcattcattcactccactaccagaatttccacccgacggtttttcgcccgcccggctttactgccgttatccgccaccggcaccgtatcgcccttgccgacgatatgtacccgtccggcaggtacgccgccggaggtcagcaacgccgcaacttccgccgcccgtttttccgatagcaccaggttggatgggaattcagccgaatgaatgggctggctgtcagtgtgacccgttacagtgactgcgccgcccacgcgggcgatttcccgcgccgctttgttaatcactggccggattgcgtcactcaccgttttttgtcccggtacaaacatggcgtcgccacggaagaccaccctactgtgctggtcatcttcgtccacggtcagcaggccacgggcgatttcgtttgccagcaggattttcagccgcagcttatgaaccggcacgggcggcggcagttttataccaatcgcatcaatatgctgttgtacggtgacggtctgcacatccatccggtggctgtaaaggccaaacagcgtcagcatcgccaacagggctatcccggcgctcagccagaccggcacccggcgcatccgccgcagtcgtccgcttatcgccccctgaaagtcaggcgagagcgcgggcatgaccggatcgcgacgctgtgaaagctgtgtcagcagttgctgacgaatattgtccagttgcttacgcccgtctggctgcacgctgtagcggccttcaaatcccagccccagcaggtggtagataacctccagtacgttgccatgttcctggaagctggccgccagacgcccgatgatctggaaaagttttatcccgccttcgctttcaccatgaaatgttaccagcaggctttttccggcccagacgccgcgccgcccccaggttgtgttattggcggcttcatcaagcgccgtacacaggcagtaacgtaccgccagtacgtgctcgcgccgcaggttcgcctgatcgcataatgtctggtacagatgcatctcgcgtaccagcagattacggtaaggctctaccagggccgcatccagtttagcgggcatggctgcgagagcgcacaataaaggccgggcagcggcgagcaacgggttagccgccgcgctgatttcagccagccggagtttgctgtccggaccgtcttcaacgatgacattgagttccgtgcgctggctggtgtgtaccggcgtttcatattcactgtccttatgttccggcgtggtggacaaaaaggacatcatgtccgccgctggcggcgtcagggtactgtctgtcatttatcgcgcactccccacagttctgtctccagccccggaaattccccggcggtatgcatggccatcccgccgtaacgggcaatgtgttcccacaatgctccctcgcggcggatgtcgtaatagatgtatccggcctgaaacgggatttggcgcggtggtacaggcagaacctgcaaagccagccccggcagatgcgagcggatcagttccggcaggcgatcggatggcccgattttggtctgggcggcaaaatgttgcagtagcacatcggtcggcattgaagcctttatcgccagtaccagcgtgctgaaatcggcaagatcggaaggggccaccaccgcattcaggataccgtaagtcccctctttcagctcgatgcgctgcgcgccccggatcagtaccgcgttcagcaggaactgcacctcatcaaccagcgatttcaacccggcatagggcgtcaggtgtttgtactctttgtattcagcgggccgtcgcgtttgtggacgcacataggtggagagttccccggccagttcggacaggtagcgatacaacacttccggggccagcggggttttcgccaggtgagtcagcagcggctcaaagcgattgagaatttgcagcagcaggtaatcggagacctccgctgcttcatggccgtggttgtcgctgccggtcagccgttccgccagcgaatcggcccgcatccggatgagatcgttgatccacgacagccaggtacacatcagtgaactggcctgataattaatgatgggcgggatcaggtcgtggtcgatatctatccgcccgtcagggttcaacccggtgatgcgggtcaacggcaggccaatccaggcgcccgtcaccgccttttccggcagcagccgcaggcgcagatgactgagctgtaataactgcgcgccacgtcccagcgagttggcgtcgcggatgtcgtgttcatgtaccgagaaacgcgccagtgattccgggttattgtcaaacgtggtttcttcgctgttcggcgcgcgtaccggtaccgccagacaaatctgctggttcaggtgctccggcaggatggtcagcggcggcggcagcggggtgtggttcggtgcgttaaacggcgtgccgtcaggaaaaatccctgatgcctctttcagtatcagtttaccgatgttcagcgcttcgccatcaatattgtagtggctgaatccccagaaaaagggagtcagcggcaggctgcggtaatgcatgacgtgttccagataacgctcttgctgctgaaacatctgcggcagtaaaaattgtccttcactccagactacgcggtcattccagctcataattcatttatcccgttccgtaattacaatggcgctttgttccagttccgcctccaactgcacttttcctttccccggtatgaagctgctgtaccaggctttttccggggcttccgggattttgtaggttacccgccagaccgatttggccaggttacggtatccggccagtacgccgattgccgtggtctgcgcattcagcgggcgacgcagttttttctcttcgccgggacgcaaaataaagctgtcgcgacgcactaaatcgtcggtaaggacggatttgtcgttgtcatggagcgaccagtaatcagctgtcgtgaaagcggcgtcattttttagttcataaacacgtatctcaatgggcgcggccttcttctgattgtcaggattcaccttatcggaggctttcacgctcaggtcgagtcgctgtgattcgaggtcaggtaacgcatcgctactgccgcatccggaaagcaggagcagtgcaaaaggcatagctaccgcacataaccaccgagtggggttacgccattcattcactgtaaattcctttaaaatcaaaacaataaatccggccagatataaatctggccggaaaaacagccgttaaatttctttgttcgccttgaagtcgtaacctgcggtgatagtgccgccgctgccgccctgctggttctgcaccacgtattcctgtttcacagtgctgaaagaaagctcgaccgtttcacgggaggcgatttcaccatcgtggctgccgctcggggaaaccacggcgacaatcaggtcggtgaaggtatacttgaggtactccagcggattgccgccagccttacgcataaccagaatggcctgcggaatgtgcttgccggaggcgcagtatttgaacaggttcgggctggcgcgatcgatatagtgatcaaaatccagattagtgacggagaccttaccggagccgaggccgctaccggcgtgcatggtggattcctgatgaatattccagcgccagctcagtacttcaatttcatttttgtgtttgtcatccattgactcgccatcaatgccgtcaatttttaaaaaaatgtcataagccatttttatatccttattaagttttacttaaaataaacctggtttatcctgataatttgcgcagaaataaaccgttgccgtacagaatccccttccccgtaatttcaggagaacagaaggctgtctttttccgctgccaatattattgaagtatttacttcacgaataaatcttaaacattaacaggcatcttttatgcgtattctggcatcagagtattcatataaagattatatattttatttacaaatcaatttcgccggtaagacatccgggctccagcatgtcgcaaccgttccctgaacttttctggcaagcagaacagcccactgtccataactacacgagaaccagatcccccggcgattatcctctgggtctatctcccacaggtgcccctttttcccatcaacgactgcatcttcacctttcagatctgcctgctctttgggatcgccagacgaaagaaaaccaccatcattcaacatacgcgctgcacgggatgagacattccatccttccgctgaggaaattattggagcctgagaaaaatgaataaccgcagggcagacaatctcatcggcatgaacaactattaccggaagtaaccacagaatgcccccgacaatacaggtgctattcaacgataaaataggcttctgcattattactcatccttatataagtcccgtcactacgaacacttccattatgcaactttcttatataacgtttggacacacggggttttgcgatatcatctttccattgatccatcacccatatcccgccagtatcttgccccaaaaaaaatgcagcatggttgccactattgtggttcggatatcgcccattcacaaaagtagcgataactgtcccgacttcaatgtttttgtttccaaatactgcggccccttgctgccatgtactcgcttgtcctactcgtatatagtgttgaataagttcaacacactgatggtggtttcctaccttttctgtatcctgtaaagcctttgcattagcataaacatatggcatatattctcttaatatcctctgatattatttatacattcacaaaataaatgcatcaggcattgccctgcttcactgacggcagttttgtcaccaggcgcagcgatcctgtcagcccttcaagctggaaatgcggacgcaggaagaatttcgcgtcgtaataacctggattgccttccacctcttccaccactacctccgcggcagccagcggacgacgggctttggtttcttgcgaggagttcaccggatcggcgtcgacataattcataatccattcatttagccagcgctgcatatcctcgcgctctttaaaggaaccgattttgtcgcggacgatacatttgaggaagtgcgcgaagcgcgagcaggcgaacaggtacggcagacgggcggacaggttagcgttagccgtcgcgtccggatcgtagtattcctgtggtttttgcagcgattgtgcgccgataaaggcggcatagtctgagtttttacggtggatcaacgggataaaaccgtttttcgccagttcagcctcgcggcggtcagagatggcgatttcggtcgggcatttcatgtccacgccgccatcgtcagtcgggaaggtatggcagggaagattttccaccgcaccgcctgattccacaccgcgaatcaacgtacaccagccgtagtgtttgaaggaacggttgatgtttacgcccatcgcgtaggccgcgttgctccagacgtatttggtatggtcagaaccatccgcatcttcttcaaaatcaaactcgtccaccgggttggtttttgcgccatacggcaggcgggcaagaaaacgcggcatcgtcaggccaatataacgggagtcttcgctagcccgcagcgagttccacggcgcatattccaggttctgggtgacgattttggtcaggtcgcggggattcgccagctcctgccaggagtccatttgcagtaccgagggggaagccccggcaataaacggcgcatgggccgacgcggcgactttggcgatagagccaagcagatccacatcgggcggtgtatggtcgaagtagtaatccgcaatgatacagccataaggttcgccgcctaactggccgtattcggcttcatacagtttcttgaacatcgggctttgatcccaggcggtgcccttgtaacgcttcatgttgcgccgcaattcatcttttgacagattcatgaagcgaattttcagcttttcgtcggtctcggtgttgtaaaccagatgctccataccgcgccacgaggattccagcttctgccagtcgggatgttgcaggatcagtttgatctgttcggtcagtttaaagtcgatctgcgcaataatagcgctgatgcttttataggcgtcatcgctgacggtgatcgtgttcgccagcgcctgttgcgccagcgtctacaccgcggcttccacagcttttgccgcctgggtagtcttgggtcggaaggcctgattcagcaacgcatcaaattcaccggatgcggagacggtatcctgagcaaccgcgtcggttgcctgcatattactgtttgccatgaaaattccttaaaaattcgacattattccgctgattcattatccgctgacacaccttgctgggtagcggccgatttcggcgcattcgccagcgttttcagcagagtcgggtcctgcaacagtttattgaccagattttccgccccggccttgccatccatgtaggtctggaggttcgccagttgagtgcgggcttccagtaactggttcagggcgtccaccttgcgggcaatctgtgccggcgaaaagtcgtccatattttccagggtgatatcgaccatcaactgaccttcacccgtcagcgtattcggcacagcgaacgccacgcgcggcgcaatggctttcatgcgctcattgaagttatcaatatcaatatcgaggaatttgcgatccgtcaccggcggcagttcttcacgcggtttcccggccagatcggccagcaccgccatcacgaacggcagctcgatttttttctcggaaccgtaaatctctacgtcatattcaatctgcacgcgcggcgcgcggttgcgcgcgatgaatttctgcgcgctattgttgatagccataatccttcatttcctttttagtcaactggttgccgcaaggggagcggtataccggtacagtttttaaaaatcatactcagagagtttttttataatctctttgttttctttgtacttttcccgtaacccaggaagtgcttttttcgccggagggcaccaggtattaatgcccttttttatgtcttttttatcctcttccggtaaagaactgtcccattcgccggccagatgctggcacatctctgcattgctcagaaaatgctgcacatcctgtggtaaaggcggttcgccatgaacactgaaagcgaacatcattagcaaaggagtcaataacgccgggtcacgtaatgtcatatttaatgcccatcaattgaccagtggggtttatctgtatttccgccgacaaacttagtcacgccataaacccactgcgcaccacttaactcttttggcatattccctcctgcgaggttgtctcaaaaacaatctgctcatcaccattaacgccgatatcaatctgcctgatagcggctttttccgtcatggcctgcaaccagtagcgcgacagttgtggcaggatgtgctgttcgatgtagccaatcagcaaccgcgcgcccgtttcatgcattggacagcacgccacaatatgtgcgaccagttcctcactatacgtcagcgtcaccccgtgctgttcacccatccgcgccaccagccggtcaagatgcagacgggcaatcacgccacgcgacgtttcatccagcggcaggtaagggatcaccgtcacgcggcccagaaatgccgccgggaaatgcttgcgcaattccggcattagcgcctctttaagccccgtagcatcgggcattaaggccggatcttcacacatctggctgatgaggtcggaacctacattggtggtgagtagtagcgtggtgtttttgaaatcgacatgtgttccctcaccgtcctccatcccgcccttgtcaaacacctgatagaagagttcatggacgtcatggtgcgctttttcgatctcgtcgagcagcactacgctccaggggtgacgacgcaccgcttccgtcagcacaccaccctcgccatagcccacatagccgggcggcgcgcctttcagtgtggaaacggtgtgagcctcctggaactcgctcatattgatggttaccaggttctgctcaccgccgtagatagcctccgccagcgccagcgcggtttcggttttaccgacaccggacggcccggccagcataaacacgcccaccggtttgcgtggatcgcccagtcccgccctggcggtctgaatacgttcaccaatctgcgccagcgcgccgtcttgcccggtaacgcgttgcgccagtcgggcaggcagttccagcacctggctggcctcatctttcaccatgcgcccggcaggaataccggtccagtcggcgacaatcgccgcgacaatcgccgcgctgacttccgggaacaccaccggcgcgtcgccctgccactcccttagcgctgtttcggcctgttgcagcgtggttttgtcatcagcatcagactctgcgacacgcagttcctgcaacgtatgtaccagttccagctcccgctgccagcgggattcggatgcagtcagttcatcgttgagcgagaaaattcgcgccgtcagcgcatcgcaccgctcatctgactgaatccccattttttcctgcttctgcaacagcgaccgttccatttccgccgcttttagctgctgacgcaggaactgtacgctggcaggcggcgtgtgcagcgtcagcgccacgcggaccgcggcggtatccagtaggctgatggccttatccggcaactgccgggcgggaatgtagcggtgagaaagctgtaccgccgcacgtaccgcctcatccagaatcagtacgttatggtgtttttccagcgtatccaccagaccacgcaccatttccattgcggggatctcttccggctcggcaatctgcaacacctgaaaacgacgggtcagcgccggatctttctcaatatggcgcttgtattcgctccaggtggtggcgccgatagtccgcagggtgccgcacgccagcgccggtttcagcaggttagcggcatcgcccgtgccggatgcgccgcccgcgcccaccagagtgtgaacttcatcgacaaacagaataaccggctgcggcgagcgcccggcctcttccagtaaccctttcagacgcgattcaaactcgcctttcatgctggctccggccaacagagcgccaacgtccagcgccagcagccgtacttcccgcagcgcgggcggcacttccccctgcgcaatcgcgagggcaaaaccttcgacgaccgccgtctttccgacgcccgcctcaccagtcagtaggggattattctggcgacggcgcagcagaatatccgtcatggtgcggatttcatgctcacgccccgtcaccgggtcgattttgccgtcgcgcgcctgtgccgtcatgtcctgacagtattttgccagcgcggatttaccgtcctgcacgccgttgggaatcgcctggctgctttcaccgggaatggctgatgccagaccggagccgtcgtaagggcgctcctgcgcttccggcgatgtttcgatcaacgagggcagtatttccgtcagttcatcaaccggaagcgtggccagcggcgcgcagatactgctcagtacccgacgcagttctggcgtggtcaacaaggccagcagcaaccagccgctgcgaattttgttatcgccgtaacggacgctcgccagcatccaggccttttcaacgctgagatcgatatggtgagaaaaatcactaatggcgctggccccggcgggcagcatatccagttgccggagtaacgctttctccacatcagaaagagggatctggtaatgccgaagaacgtggagaatatcgttatcgggctgctgtgttaactggtgcagccagtgagtcagctcaccccagggattagagcgtagtttgcaaaatgccgttgccgattccagcgaccggaatagtgggccggccagttttccatataacgcactgcgtgaaacaggagtttccatttgttatgccttgtgacataaaaattcataaaaataatgcatcaatgcacatgaatatataaacaattctttattaaaatgttcgacaaaatatcgaaacaaaacaatgatacagatcagggactaattagcaaccaagccgttaatattaaataatcaatgaacaacaagataaaaatcgcaattacagaattaaaagaaataatatttcaaaaaagacatctatgcatacaacaatgcattcacgacgaaaataataaaaagggtgtcatcaataatgactccctatgaatttagttaaaattatttatgaattaaaactccctaaacgtttcctccagaaaaataaatacatttaagggacataatgaaacaagacatgtgggaattacggaaaatacagtcgcagggtataacggataacgcacagtatcccgcagggacatacatcgtatttactgccgccgccccctacattccgctttttgagcaacatgggaaagacgatatcgcgctcagtcttgttcgccacgaagaggcgtggtggattgttaatcactcggatgaactgtgctgtgccgtcaatgagcaggtgatggaacctcatcaccgtatgcggctgaatgatggagatacgattgaatggggtctgtcatcctggtgccttgcccgcaccaatgatgagtcccgtcccgatgtttcgtttcctcagttggttcagtcatctgaatccgttgctgagtacctggatctggactggtttaaacaacaacagctcaatccgcagaacccgttcgatattattcccgtccgggaaaccgcgccctcttacaccggccatgaagcggatagcacgctacaccagctttaccaggaatatcagcaggccttgcggccctccgggcaggaaaagcccctccgtcctaaaccgtttccccgaaatgaagacgctgtcacccaggatttgacgtcgttatacgataaaaagggcgataccgacacgttacaggatatggtggcaggcgcgcccggtattgatgccattctggatacgctggacacgaccggtgagggtgaaatgcactggctggcgatggaatcaatgcccgatatcctacaactgctctcgccggaaatgggggggaaaaccgcacatagcgagatactgcccgatctgacccgccgcgagcatcgtattattggcatcgatagccactaccgaatcactccgacacagaaaaatggaaataccgcccatgaaaaaaactgacacgcttcctgctaccctgtccgcgctgctacaggaatactctattgcggaggggattcagatggcggagcagcaggttcgggaaaatccggcgaaggcgctctgccgccacagcctgtttcagttgctgtgtgtggccggagactgggcgcgggcgctacaccagcttcagctctgtgccaggatggaggcaaattatacccaggaggcccggctgtaccgggagctggtttgctgcgaaatgttccgccacaccgtttttcagggtgaacaacgacccggttttcttctgccgcagcccgtttgggtggagtcactgctggcggcactcgcctgtcatgacgataccggtgaggttgataaacaccgtaataccgcactggaagccataacagacacgggcgggcagtggaacggcggcgcatttgactgggcgagcgacagcgattcccgccttggcccggtacttgagctggtcaccggcggcgtgtatatctggctaccgttttcgcaaatacgctcgctggaatcgccgcaaccgacgcgcctgaccgatctgctgtggaaacccgttaatatcaccctggtgaatggcgatacgcacggtgcctggctctttacccgttacagcggttcggaaagtgcatctgacgccctgcgtctgtgccgggaaaccgcctggcaggacggccccggcgaaaccaccgtgcgagcgctggggcagaaagtgtggctgaccagccacggcgatatcagcctgctggacatgacccattgtacctttcatgctcaggaaaacgatggcgcatgagcacgtctcgttttacacccgctaaccacctgctgcctacgctgtttgatcggctgtgtgacaatgctccgtatcagaaaattgaccgggatatcagcgtcacgccggtacaactgaaggagatcattcgtcgggatctctcctttttgctcaataccattagccacgagggtgacatcgacgcccggcgctatccgcaggcggcggcgtcagtgctcaactatggcctgccgccgctggcgggcagctttatgtatgagcacaagtgggacgatatcagcgaggcgatccggcgcgccattatccgtttcgaaccccggctgaacgccgccacactcagggtcacgcccttgctcgatgaagcccggcagggtagctataacacgctacagtttgaaattcgcggacaaattctgacgcagccgtatcccacggagtttctggtacgcagcgcgctggatatggagctgagccgcattacgttcttttaatacagggcattattcatggatccacggctactggagtattacaaccgcgaactgagttacctgcgggagaccggtgctgagttcgccaccctccatcccaaaattgccgcccgactggggatgcagggaaccgatattgccgacccgtatgtggaacgcatgatcgaggcgttcagctttctgagcgcccgcactcagctaaaaattgacgccgaatttccccgcttcacacagcggttactggaagtcgtcaaccccaattacgtcacccccacgccatcgatggcagtggtaaagctgtatcccgatacgcaggaaggcgacctggcgaaaggggtcaccgtgccgcgcgataccgcgttcgtttcccccatcccggaaggcgaaaataccgcctgccagtttcgcagcagccaggacgtcacgctgtggccgctgtccatcgaggaggtacgcctgaccgccgcgccgccggatatgcccgccctgcaccgctatctgccgcctaatattcatgtcgccggggcattgcgcatcaccctgcgaaccttcggggaactggctttcagcgagctggccggtccggcacggctgctcttttacctctgcggcgaagaacgcattgcgtcacacctgtttgagctgctacataccagcgccgtcgccacactggccggagaacccggtcactttgacggcgaactgaatgtgaatcttcaacacccggtggcgcacgaagggctggagccagggcaggggctgctgccgctcgcctggaacgtgtttcatgggcataatctgctgcatgaatttttcgcctgtccggaacggttttacttcttcaccccgaccggattgtctgccggtctacaaaaggtgcagggcaatgtggcggaaattgttatactgcttaaccgcctgccgccggactggctgattcatcagacggacgccgcacagttcagcctgttctgtacgccggtgatcaacctgtttccccgcaccaccacccggattgaagtcactcacagcgtgacggaacagcatctggtggtggatcgtacccgtccgctggattacgaggtgttttctgtccaggaagtcgaaggcctggaagcggaaaccacacggaagatgatttttcgtccgctgtatcacacccgtaataatgacgaaggcaaccacgggcgttatttttcactgcgtcgtgagccgcgccgatcgtcagaaagcgcccgccgctatggcacccgaaccccctataccggctcggaagtcttcctctcgctggttgatcagcatgaagcgccctacccggaaaatctgcgccatatcaccgtcacggcaatggtgactaaccgcgatctgccctgccttattccacgtaatggccgggatgatctgaccgtagatgcggcgattccggtggcgggcgtgggtcttatcagaccgccgcgcccgccgcagccgccgctggctgaacgcgaaatggcctggcggctgatccggcagttgtcgtttaattatctgccgctggccgatctggatcaccgcaccggcggccaggcgctgcgcgatctgctgaacctgtttatcccggctcacgacagcccgcagtcgcgccaggtgcgcagcctgattggctgcaaaaccaccccggtgacccgccgcctacccggctccggcctgttggtctatggccggggcgtcagttgcgaactgaccgtggacgaagaaggattttccggtatcagtccttacctgttcggtctggtgctggaacactatattgcccgccatgtttccattaataccttctcgcagatgacactgcactcgatgcaacgcgggcatgtcatgacctggccggtcagaaccgggcaacgggggagcgtatgaccggcgctctcgaccaggcgcagaaagccccctggcgttacggattcctgaacctgatgcgacgcgtggatgcccagctctgtgatactccggcaggcagtatctggcagcctcggatggaaaaattccgtctgggacagacgccgacgatgacctttgcaccacgggaaatcgcccaggtcagctggcaggatggacgcctgcacctgagcctgtacagcctcggactatgggggccaaacggcccgttgccgctgcactataccgagctggcgctaaatcgctcagagagtcgtcacgatccgacgctggttcatttttccaatatttttcactaccgctggctgacgcagttctggcaggcatggcgcagcggccagtccgctggtggcgggctggacaaaccggaacacgaccgttttgcgttttatatcgccagtatcagcgggcaggatctacgggaaagcgccgaaagcccgctgtcagatcatgttcgcctggcggcctccgcccatctggtacgcgagtcgcgcaatcctgacgggctggccgccacgctggcgcactatttcagcgtaccttttgcggtgaaagagtttgccctgcactggataacggtggcgaacgatgaaatcacccgtctgggcacgcccgcgcagtcttcggtgctgggcaacggggcgcttatcggccaggccgtaccggatatgcagtacaaattccggctaattatcggcccgctcacgctggaggattacctgcgttttctgcccggcggcaacaatctgcccgtgctgacagaactggtgcgtacgttcatcggttttgaatattgctgggaaattgagctgcagttgaagccccatgccgcaccgcctgcggtgatcggcggcgcgcagcggcttggctggacggcctgggcaggtaaagccatgcatgaccgtccggtgaccggcatgatttttgaacctgaacacggcttaacccactgagagtaatgatatggacatgtccctgactaaaccggtaagcgcggaacaaccctgcggccccgatccggagtacgatccggaatacctgctgctgttcagccgcgccgccccccaggcggaggcgcaatatggtgattttgtcagtacgccggaagccgtgaactggccggaaattgagcgtgatgcgcgccgtctgctcacgcgcagtaaggatatccgggtgttgatcctgctgctgcgcagtcgcatccagcaggctggcgcacagggactggcggaaatgctcacacaactggcagaactgagcgtaatctggtctgatgcactccatccacagctgcttaccggcgaaggcgcatccgcagaatctattgaagatgcggcgctggcgcgcagtaatgccctggcggcgcgctggatcacgaaggcgtgatggcagacattcgcggtatcacgctgtcaaacagtgccgccctgcacctgcaggtacgggacgtggagcgcgcgttatccgcccctcgcccggctgatgcgctggcccccgaatccgtccgccagcaactggcagacctcgaagcccgtggggcattaccgctagcggcgtttcgcgaagcgcaggaaagcgcagaacgcctgcaagtgtgggcgcgtgagacattaggcgatctggctccagatttttcacgcctgcggcagttgttagcgctgctgcctgacgtggtacagacaaccacgccggaaatccctccgtcgccagcgccagcgccagctcccgcaggcacggttatggataatgccattcctgcacgggcagaggatgtgccgcctgtcaacgcgccacccggtatatctatcccacacaatgctgaaccggggccaattcgcgatcgtaatgatgcgctggaacgcctgcggtgcattcgtcgctggtttgagagcagtgaacccagcagcccgaccatcccactattacgtcaggctgaaagactggtgggaaaacggttctcggaggtgatcaatgagatcccggtggagttgctggagaagtgggatgccctggagtgatgatgcgcatgtctggcggttctccgtgattatctgagtgacatcaacattactcggtctgcttctgcgctgaacatgtcccgatcccggttaagcaccgccatgaggccgcgccttaaatgtcagtgggacaaaataaccatgacagtgaaagaagtggcggtaatatcctgttcgtcatccaggcgtaggcccatttgcgccagattccacgatagacggtggaacttcttgaagacgaaaaaaaaccgtatcccttttacagtgatacggtttttttacttcacaggatgtataaaaacaccctgagatttgtatctggcggaacggacgggactcgaacccgcgaccccctgcgtgacaggcaggtattctaaccaactgaactaccgctccgtgatgttcccgctgggaacgaggcgaatattacggtttgcggtgtcgcccgtcaacgctttttctcaccttttgaatcagttgctgcaaaaatcgcccgaaggatgatttttatagcctaaaaaggaataaattatgcccgccaaaggcaacttccgccctttttctgcaccagatcaagccgcgattcatgcgcagccagctcttcctcagaggcaaaaacgacccgtaaccggctggcctggcgaacgattcgctgaatggtcgcttcaccttgctgccgttgcgtctctccttccatcgcaaacgtcatggacgtttgtccgcccgtcatcgccagatacacttcggcaaggatctgggcatcgagcaatgcgccgtgcaaagtacgtttgctattatctatctcataacgcgaacacagcgcatcaaggctgttacgcttgccggggaacattttccgcgccaacgccaggctatcggtaactttgcagaaagtattggttttaggaatatcgcgtttaagcagaccaaactcataatccataaagccgatatcgaacgatgcgttatggatgaccagctccgcgccgcggatataatcgagaaactcatcgaccacatcagcaaaaaccggcttatccagcagaaactcatcggcaataccgtgtacgccaaacgcttccggatccaccagccgatccggcttcaggtaaacatgaaaattgttgccggtcagacgacggtttatcacctcaaccgcaccgatctcaataatcttgtgaccttcatagtgcgcgcctatctggttcataccggtggtttcggtatcgaggacaatctgtcgtgtaattgcagtgctcatatcggtcatttatgtcagacttgcgttttgttatcgatttcaattacaggaagtctaccagagatgcttaaacaggtagaaattttcaccgatggctcttgcctggggaatccagggcctggtggttatggcgctatcttacgctatcgcggtcatgaaaaaacgtttagtgaaggttacacgctgaccaccaataaccgtatggaactgatggcggcgatcgtcgcgcttgaagcgttaaaagaacattgcgaagtgacattgagcaccgacagccaatatgtgcggcaaggaattacccaatggattcataactggaagaaacgcggctggaaaacagcggaaaagaaacctgtaaaaaatgtcgatctctggaaacgtctcgatgctgcgttaggccagcatcagatcaaatgggtatgggtcaaaggccatgcaggccatcccgaaaacgagcgttgtgatgaactggcgcgcgccgcggcaatgaatcccacgcaggaagatagtggctaccaggcagaagcttagccatccggtttgcgatattgccgggtggcgccaacggtctggcggataggggttttacttttattatgtcgcagcggattaagcgtaagcggaatggtccgcttacgggccacaataagctgtaaacagcccagcgccgggatatgcgtatttaaaagccgccctccctgctttttccagggtaagacatgaaaacggctataatgtagcacttcgaaattgagtaaagacagccagtccagttgccgcataagggtaaacatccgactattatagggcggtgttttacgtaaaacgagtaccagtttacgtaaccccatcaaactcagcgggttaaatccactgatgaccagccaaccgtcatcaatcaatacgcggtcggcttcccgcaataaacggtgcgggtcggtacaccacggcaaagtatgcgccagcagacaaacatcgacggatttatccgcaaaaggaagatgtagcggatcggccagaacctgcatcggcgacccctgcgatgaaacattcacttgatgggagaccgcgcacgcttcggaattgatttctgcgcttaaattaccgattttaagcaaatggaaaccatacatttttgcaaaccacggatttagctgctgttccagcgcctcacggtagtaattgccccagggcaactcaccccaacatccgggcgcaacgacagtttgagagagccttgccggtttcatcgcaaccttccgctaattatttgagaggtaatatatgaatcttaacagtattcccgcgtttcaggacaattacatctgggtgctgaccaatgatgaaggccgctgtgtgattgttgatcccggcgaagcggcccccgtcttaaaggccattgctgcacataagtggatgccggaggcgatttttctgacgcatcaccattacgaccatgttggcggagtcaaagagctgttgcaacacttcccgcaaatgacggtttatggaccggcggaaacgcaagacaagggagcaacccatcttgttggcgatggcgatactattcgcgttttaggcgagaaatttactctttttgccacgccgggccacacgttaggacacgtctgttactttagccatccttacttgttctgcggcgacacgctgttctctggcggctgtggtagattgtttgaaggcacgccatcacagatgtatcagtcacttatgaaaattaactctctgcctgacgacacactcatttgcagcgctcacgaatacactttagctaacattaagttcgcattgagcatacttccgcacgattcgttcataaatgaatattatcgtaaagttaaagagttacgtgtaaaaaaacaaatgacactacccgttattcttaaaaatgagcgtaagattaatctttttttaagaactgaagatattgatttaattaatgaaataaacaaagaaacaatattgcaacaaccagaagcgcgttttgcatggttaaggtcaaagaaagacacgttctgataattcttacttgtcattcgctaacttcgccgttatgatcggtcgtcttttaagcaactattgacacacacatgaaggcaaaagcgatattactcgcctctgtcctgcttgtggggtgccagacatctcagaacactggcaacgtccaacagcacgcacagagcctttctgcagctggtcaaggggaagcaggaaagtttacgagtcaggcacgatggatggacgacggaacgtctatcgcgccagatcaggacttgtgggctttcattggcgacgagctaaagatgggaattccggaaaacagccggattcgcgaacagaaacagaagtatttacgcaataagagctatctccacgatgtaactttacgggcagagccgtatatgtactggatagcggggcaggttaagaaacgtaacatgcctatggagctggtactactacccatagtggagagcgcttttgatcctcacgcaacgtctggcgccaatgccgcaggcatctggcagatcataccgagcacagggcgcaattatggtttaaagcagacccgtaattatgacgcgcgtcgcgatgttgtagcctctacgaccgccgcgttagacatgatgcagcgtctgaacaaaatgtttgacggcgactggctgttaactgttgcagcgtataacagcggcgaaggccgtgttatgcgggcaattaaagcaaacaaagcgcgtggaaaaccgacggatttctggtcgctttctttgcccagagaaacgaaactctacgtacctaagatgctggcattgagtgaaattctcaaaaacagcaaacgctacggcgtacgtctgccaacaacagatgaaagccgagcgctggcacgagttcgtttaaacagtccagttgaaatggcccaggttgcggatatggcgggcatgtctatcagcaagctgaagacgtttaatgccggtgtaaaagggtctaccttaggcgtaagcggtccgcaatatgttatggtgcccaaaaagcatgccgagcagttgcgtgagtcgctggcttccggtgagattgacgccgttcagtcccaactgatcgccgacaatacgccgttgaatagccgtagctataaggtgcgctctggcgatacgctttccggtattgcttcgcggcttggcgtaagcacgaaggacttgcagcagtggaacaacctgcgtggttcccgcctgaaaatcgggcaaagcctgaccgtgggcgctggcagcagcgcgcaacgactggcaaacaatagcgatagcattacctatcgtgtccgtaaaggcgattcgctttccagtatcgccagacgtcacggggtgaatatcaaagatgtgatgcgctggaaccatgatacggataatctacaaccgggcgatcagcttacgttgtttgtgaaggacaatagcacgccagactcctgatattgtccgacgaaaaagccaaaaggcgccgcttcccccggcgccttttaaattgttataccgctttatgcgcttccagcatgatagtatcgctgctaaacgagccgtcatcctgcaactcaaaataacgcttcacctctaccggggcgctcgcctgatataatcgaatcgcctcaaccaacggcgctggcgtacgcatccgcgttacccatgagcgaaactccagcgataaacgatcggttatcacggtattcgttaccagcatcgcgttattgaccatcgccagccattcaccactggaatagttacggacatgcgacgtgtcgcgtaacgcctccaccgtttgcagccagatatcgcgtacaggatgtccaggcgacatgacatccatgataatcagcacgccgccgggttttaatacacgataaacctcacgcaatgcctgaccaacgtcgtgccagtgatgcgcggaatagcggctaatcaccacctcaaacgatgcatcttcaaagggcagtttttcggcatagccttgccggagagtaatattacttaaatgtctttcttccgccgctccagcgacaacctcaagcatgctggcggataaatcgtatgccacgaccgaattgacatgttgcgcagcgacaaaactcgcgtgtccagccccacatcccatatccagtacgctcgcgtgggaaaaatcagacaacctttgcgccagccgcgctaagtcacgacccgctgcgtgaacggcgctatgtaaataggcgttcgcctgtgaaccaaactgcttttcaacattgtcatggtgggaatgcgttgtcatggtagtgcccttctgttatgagaaaaatagagggcagcacccgcagaggcctgccccacggcagacctgactcacctttattgctcaggtttgccgggactgaattcaacgagtagcggattgtgatcggaagcgcgcgtcaccagtacggaggcttcattcacgtttaaaccacgataaaaaacaaaatccagcggtcgtccaaacgcacgacggcgttgatcgtcagtgaaacgcacctggcgcagcgacatctcacgtgcaaagcggtacaacgcattcatacgtgggcggctccaggcattaaaatcacccgccataatgacagggccgctatggtgcgcaatctggtcgccgatcggaagtaactgcttactgtatacgtccacgcccagactaaaatttaccgcatgaacatttactaccattaataaacgggtatccggcaagggatataccgtcaccagggctgatttcgccaaacgtaaaattggttctctttcccgtaaagggcagcagtaaacaggatgggcggcagaaagcgtcataacgccagacgggtgctgaggtaatacaaaagcgggaacctgatcggcggcaagatagttagcggtggcaaactgtaccagttcaggcgtcgtctgggcctcctgcaacaggaccagatgcgcatctttgccgtagttcttcagcaccgataaccattcggctcgctgctgcttgaatatattccacacgaggatacggatccgctcttcactgcttagcggttccccggcgggcaatgcctggccaatgctcgcaaacgaccctagcggcaaaatccgctcggcgggctgtccggcaacatagcgcatcgcataggtgttttttcgcacttttgactttcaaacctctgtaacgtcaaccagtcctcaaccggactggttcttctgttatagggattttagcactcactttcaacgaacaattgcagtttgttttgtaagtaggcgcttacatcaataatttactccagagcaatgcgcacaggtttatcaagacgtccgctgacgcccatcagcagaaaagccaccagaacaatgagggcgccaatccacggcgtctgcgccaaaccgtaatgcgccaccgtttgtccgccaatcacggaacccagcgcaataccaatgttaaacgccgcaatgttcagacctgacgccacatcaacggcattaggcgtgaattgttccgctttctgtaccacgtagacctgcaaccccggtacgttaccgaaggcaaagatccccatcaccagaatggtagccagcgcggcatactgcgtggaggccgtcacctggaagaccatcagcagaacaaacagcgcggcgaaaatgaatttcagagccggcacggcaccatgcttatccgccagtttaccgccccagatattgccgatagccactgatacgccataacccagtaggatccagcttactgctgccggagagaatcccgccagatcctgcatcatcggcgccaggaaggtgaatgccgtgaataccccgccgtagcccagcgccgtaacggcgtaaatcagcagcagacgaggatgagtcagtactttcacctggtcacgaatgctggcggccgcccgaccaggaatattggcagggatcagcagttgactgctcatcagcgcaatcacgcctaacagtgataccgcaaggaaggtctcacgccagccaaaatgctgaccgataaatgtccccagcggaacacctgttaccagcgctactgttaaaccaccaaacataatagcgatagcagaagccgctttctctttcggcaccagacttgtcgcgatggtagagccaatcgagaagaacacgccgtgcgccaggcccgtcagcagacgggcggcgattaatgtcatatagcccggagcctgccacgccagcaaattccccgccgtaaacaagaccatcagcgcgaccagtaactgtttacgcggcaggcgtccggtcagagcggttagcaccggcgcgccaatagccacacccagtgcatagattaaaaccagcattccggcagaaggtaacgagacagccagttgttgtgcaatggtcggcaccaggccgacaatcacgaactcagtcgtgccaatagcgaaggcacttattgtcagtgcaaataaagcgagaggcatacataactccataacagcagtaatcagatgacacgcagtatgccaggatgttttaatgacaaaaatagccaaaatataaatttaattttgctgcaggagcagaaatgaaagccacctccgaagaacttgcaatttttgtcgctgtcgtggaaagcggcagcttcagccgggcggcagagcagctcggacaggccaattccgctgtcagtcgggcagttaaaaagctggagatgaagctcggcgtcagtctgcttaatcgaacgacccgacagttgagcctgactgaagaaggagagcgatacttcaggcgtgtgcagcagatactgcaagaaatggctgccgcagaaacggaaatcatggagtcgcgtaataccccacgcggcttactgcgtatcgatgcggcaacgccggtaatgctgcatttcctgatgccgctgattaaaccttttcgtgaacggtatccggaaataaccttgtctcttgtctcctcagaaacgttcatcaatcttattgaacgaaaagtggatgttgcgatacgcgcaggcacgttgacagattcaagtctgcgcgcacgtccgttatttaccagctatcgtaaggttatcgcctcaccggattatattgcccgttttggcaagcctgagagcgttgaagagttaaaacagcatctgtgcctggggttttctgaacctatctcgctcaatacctggccgatagcctgtagtgacggacagctccatgagatcgaatgtgggatttcgtccaacagcggggaaacgttaaaacaactttgcctgaacggtaacggcattgcatgtctttcagattatatgattgataaagagatcgcgcggggagaactggtggaactgctggccgataaacgtctgccggtagaaatgcctttcagcgccgtttactacagcgatcgcgccgtcagcacacgtattcgggcatttatcgactttttgagcgaatatataagaacagcccccgcaggagctgtgaaagaggggtaaaggtacaaaggatcgggtaattaatcccaggcaggagccagtccttccgggctaaccagacgatcgttgcagtccagcgccgcgatcgcatttttatcttcggcatccagatgcagatcctgcgccagcaggttgcttgccaggttttcacgcctggtggatgaagggatcaccgagtaaccttcgcccattgcccatgccagaataacctgcaccggggtcgcattatgtttaaccgcaatgcgcgcaatcacttcatctttcagcgctttaccgtatgccagcgtcatgtaagaggtgatatggataccgtgcgctttcgcccagtcaaccaccttacgattctgcagatacggagatagctcaatctggttggtggcgatatggtctgcgcccaccgcggcaatagccttttccatcaacggaatagtgaagtttgagatgccaatttcgcgagtcagcccttgttttttagcttccagcaatgcctgcataaattcttcgacagacacggcatcacccggagatggccagtggatcagcgtcagatcgacataatcggtacgcagttttttcaggctctctttcaggcttgggattagcttgtctttgctaaggttttcaatccagatcttggtggtgatgtacagctcattacgcggtacgccgctctcagcaatcgcctgtccaacagccgcttcattatcatagatttgcgcagtgtcgacagcacggtagcccagttcaagcgccgttttcacagaagcgataaccacgtcgtctttcaggcgaaaagtacctaaaccgaatgcagggatagtcatagaattcctctttttaatcactatgttcgttaactgaggggattatgaccttcagcgctttgtagaaaaagagcgagaaatgcagaggatttttgcgaattgagcaataattaaatcgcaggcaaagaaaaagccctgagctaatgctcagggctcttaataagtggcggaacggacgggactcgaacccgcgaccccctgcgtgacaggcaggtattctaaccaactgaactaccgctccaccgaattcttttacaaccactgatttttacatcaatttactgcttaatttgatgcctggcagttccctactctcgcatggggagaccccacactaccatcggcgctacggcgtttcacttctgagttcggcatggggtcaggtgggaccaccgcgctagtgccgccaggcaaattctgttgccggaaacgaatcttttatctttcgttcccgaaaatccggaatcagtgctgaaaatcgtctctcatccgccaaaacatcttcggcgttgtaaggttaagcctcacggttcattagtaccggttagctcaacgcatcgctgcgcttacacacccggcctatcaacgtcgtcgtcttcaacgttccttcaggagacctaaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggatcacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcggctgacttcagctccgtgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcgtcacgcctcagtgttaaagtgaaccggatttacctggaacacatacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacacacggtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacattagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccgattaagactcggtttccctccggctcccctatacagttaaccttgctacagaatataagtcgctgacccattatacaaaaggtacgcagtcaccccaccactaagccccctctgcttcttttgaggttgaacgtcgctttcgctccgttaaccgtctcctcagcaaaggatgcgtatgtggagttcaccactggcttagtggtggggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatatgcgcttttgtgtacggggctgtcaccctgtatcgcgcgcctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgaatcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttctttcgattcatcatcgtgttgcgaaaatttgagagactcacgaacaactttcgttgttctgtgtttcaattttcagcttgatccagatttttaaagagcaaaacttcgcagtgaaccctttcaggtacactctgaagtattttttcgtaaacactcacgagatggtggagctatgcgggatcgaaccgcagacctcctgcgtgcaaagcaggcgctctcccagctgagctatagccccatcgtgtagtcagaacctctttaccgataatttttcctgagacaaggcgtggaataacgaagcatacatcagtatgtgagttatttcacaacgcagtattcagggaaaatctggtaggcctgagtggacttgaaccaccgacctcacccttatcaggggtgcgctctaaccacctgagctacaagcctgtagaggttttactgctcgtttttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcacgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccacaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcaaagcagccaagctgcttcctgttaccgttcgacttgcatgtgttaggcctgccgccagcgttcaatctgagccatgatcaaactcttcaatttaaaagtttgatgctcaaagaattaaacttcgtaataaattacgtgttcactcctgagacttggtattcatttttcgtcttgcgacgtcaagaatccgtatcttcgagtgcccacacagattgtctgataaattgttaaagagcaggtgcgacgcggctttcagctcaccgtcgcgaggtggcgtatattacgctttcccgcttcagagtcaagcgtttattttcgcttttctcacagacttcttaacgaagtcttcctgacccggcggcctgtatgccgttgttccgtgtcagtggtggcgcattatagggagttattagagcctgacaagacctaaatgcaaaaaaaagctcaaccgttcacttttcaaacaacatttgaatcaaaagcctatttttgcctggtttttaaacaaaaacgagcccgttagggcccgttttattcaaatttgtgacttactgcactgccacaatacgatcatcattggcttcaaggcgaatcactttgccaggaaccagttcaccagacaggatttgctgcgccagtgggttttcgatctgctgttgaatagcacgttttaacggacgcgccccgtagaccggatcgtaaccgttggcgctcaacagtttcagcgcctcgtcggagatatggatttcataaccacgttcttccagacgtttgtacagacgctgcagctggatctgagcaatagaagcgatgtgttgctcacctaacggatggaataccacaacttcatcaatacggttgataaattccggacggaagttttggctaaccacacccagcaccatctctttcattcgaccgtaatccagttcgccaaagcgctcctgaatgagatcggaaccgaggttagaagtcataatgaccaccgtattacggaagtcgaccgttctcccctgcccgtcagtcagtcgaccgtcgtccagcacctgcaacagaatgttgaatacatccggatgcgctttttccacttcatccaacaagatgacggaataagggcgacggcgcaccgcttccgtcaaataaccgccttcttcatagccgacatatcctggaggcgccccgaccaaacgagacacggagtgtttctccataaactcagacatgtcgatacgcaccatcgcgtcgtcgctgtcgaacataaagttagccagcgctttacacagttcggttttaccgaccccggtcggcccaaggaacaggaaggaaccaatcggacggttcggatcggacagccccgcgcggctacggcgtatggcgttcgatactgcttcaacggcttcattctgcccgatcacacggctgtgtaactcttgttccatacgcaacagtttttcacgttcgccttccagcattctggaaaccggaataccggtccagcgcgccagcacttcggcaatttccgcatccgttactttgttacgtaacagacgcatggttttaccttccgactgggtcgcggcttccagctgtttttccagctccggaattttgccgtactgcagttcagacattcgcgcgaggtcgccaacgcgacgcgcctgctcgatggcgatcttcgcctgctccagctccgctttaatagtttgcgtaccagagagcgacgctttttccgctttccactcttcttctaactcagagtactgacgctctttatcgtccagttcttcattcagcatatcgagacgttttttactcgcctcgtcagactctttcatcaacgcctgctgttccagtttgagctgaataatgcggcggtcgagcctgtccagctcctccggcttcgagtcaatctgcatacgaatgctggatgccgcttcatcgatgaggtcgatagctttatccggtaactgacggtcggcgatatagcggtgagataatgttgccgccgccacaatcgccgggtcagtgatctgcacatggtgatgcagttcataacgctctttcagaccacgcaaaatcgcaatggtgtcttccaccgacggctctgccacgaacactttctggaatcgacgttccagcgccgcgtctttttcgatgtactgacgatattcgtccagcgtggtggcgcccacacagtgcagttccccacgtgccagcgccggtttcagcatgttaccggcatccatggcgccatcagctttacctgcgccaaccatggtgtgcagctcgtcgataaacaggatgacgttgccttcctgttttgcgaggtcgttcagcacgcctttcagacgctcttcaaattcgccgcgatatttcgccccggccaccagcgcgcccatatccagcgccagcacgcgacggcctttcaggccttccggtacttcaccgttgataatacgttgcgccagcccttcaacaatggcggttttacctacgcctggctcaccgattaacaccgggttgtttttagtacgacgttgcaatacctgaatggtacggcgaatttcttcatcacgaccaattaccgggtcaagcttaccttgttcagcccgctcggtcagatcgacggtatattttttcaaggcctgacgttggtcttcagccccttgatcgttcacgctttcacctccgcgcatctgttcaattgcctgagtgatattggccgtagtcgcaccggctgatttcagcagatcggttaacgtgccgcgagactcaagcgccgccagaacaaacagctctgacgaaataaaattgtccccccgtttttgcgccagcttgtcgcaaaggttcagtacgcgtaccagttccgaagaaggctgtacgtcgccgccggtgccttccacctgcggtaaacggctcagcgcctgatcgatagcagtgcgcaactggccagcattaatgccggcggaggttaataaaggacgtatcgatcccccttcctggttcagcaaggcgctcattaaatgaagaggttcgatgaattggttgtcgtgccccagcgcgagcgactgggcatcggcaagagcaagctggaatttgttagtaagacgatccagacgcataactcctcccataacaggtcaaaattgctactggagattaaatgaggtcatccctcaattattcaaggtgaatgacctgaattatgtgaaaagaaagttacccgtaccggatcgtcttgattctttaggttatatcagccaaataaaacttgccatacgacctgtcgtcttgtcgcgacgataagagaagaaagtctcactttcgctaaaggtgcagcgatccccgccatagacatgttcaacgccagtattcgccagacgttggcgtgcaagctgataaatatccgccagaaatttttccccgtgcggcaaaaatgcgctatcggcttgcgcatcttttgctaaaaatgcgtcacgcacttccggccccacttcaaacgcggccgggccaatcgccggacctaaccaggcgatgatattttctggtttgtcagcaaagcaggtgacagtttcctccagtacgccttcacataatccgcgccagcccgcatgagccgccgccacttctgtcccctcacggttacagaatagcacaggcaggcagtctgccgtcattaccgcgcagacggttcctggcgtattgctgtaagacgcatccgcacgtttggaggcataaggttctccggtaagcctcaatacatttttaccgtgaacctgttcaagccagacaggtttcgaaggcagattgcccgccgcgaacagacgcttgcggttctcttcaacatgctccgggttatcgccgcaatgcgcgcccagattcagcgagtcgtaaggcgataaactcaccccaccaatacgggtagaactacaggctgcgacgcctttcggcagcggccactgcgggacaatcagtgcattcataaccagtccacatcatctttatgatcttcgaaatcggcgcgcatcgcatcgataaggtccaccatatcttgtggaatcggcgcgtgccactccatttcgatacccgatacaggatggtagagacgcagcatcgttgcatgcagcgcctggcggtcaaacttacgcagcgtggaaataaattcttccgatgcgcctttcggtggacgtggacgaccaccgtagacctgatcgcccactaacggatgcgtaatatgcgccatatgcacgcggatctggtgcgtacgcccggtctccagacgcaacctaagacgcgtgtgcacacggaaatgttccataatgcggtagtgggtcaccgccggtttgcccataggatgcaccgacatatgggtacgtttggtcgggtgacgactgatgggttcattcaccgttcctcccgccgtcatatgtccgatcgcgaccgcttcatattcgcgggtgatctcgcgcagctgcaaagactccaccaggcgcgtttgcgccggaacggttttggccaccaccatcagccccgtcgtgtccttatccagacgatgcacaatgcccgcgcgcgggacatccgcaatcggcggataataatgtagcaacgcgttcagtaccgtaccgtccgggttacccgcgccaggatgtaccaccagatcgcgtggtttgttgataaccagaatatcgtcatcttcataaacaatatctaacgggatatcctgcgcttcaaaacgaatctcttcgtcgatctccgcatcaatagccacccgctcgccgcctaacactttttcttttggcttatcgcaaagttgaccattgaccaacacgcgctgattcaaaatccattcttttatacgcgaacgtgaataatccgggaacatttcggccaaagcctgatctaagcgttgaccgagttggttttcggagaccgttgcggtgagttgtactcgttgtgccatatacagcttcttcgtttaacgttgggttttacggctttgccgtttaatatagtgtgctattgtagctggtcttaaccgggagcaggaacagagaatctcccgtaaaacattttgaggaaagtcaaaacgtcatgacgcgcatgaaatatctggtggcagcagccacgttgagcctgtttctggcgggttgctcgggttcaaaggaagaggtgcccgataatccgccgaatgaaatctacgcgactgctcagcaaaagctgcaggacggtaactggaaacaggcaataacgcaattggaagcgttagataatcgttatccattcggaccgtattctcagcaggtgcagttggatcttatctacgcctattacaaaaacgccgatttgccgctagcgcaggccgccatcgatcgttttatgcgtcttaatccaacgcaccctaatattgactatgtcatgtacatgcgcggcctgacgaacatggcgctggatgatagcgtgctgcagggtttctttggcgtcgatcgcagcgatcgcgatccgcaacatgcgcgggcggcgttcaatgacttttcgaaactggtacgcagctatcctaatagccagtacaccaccgacgccactaagcgtctggtattcctgaaagaccgtctggcgaaatatgaatattccgtcgcagagtactataccgcgcgcggcgcatgggttgcggtcgtaaaccgggtagaaggtatgctacgcaattatcctgatacgcaggccacgcgcgatgcgttgccgctgatggaaaacgcctatcgtcagatgcagctgaatgcgcaggctgacaaagtcgcgaaaattattgccgctaacagcaaaaacacctgaagcaataccaacaagcaaaacggcagccttccggctgccgtttttttattcgatatctgatgcaacagaaatgatttcactgcaacgcatccagtcaaatatggcctgctttcagccattcctcaagtaaaagatcgcttcttcctgcgatgcctcacaaaaagttcgccttgacaaaaagtgacaaaataatgtgatttacatcacacattttgacattaagaacggtatgctggaatcaccaagacgggaaagacaagaggtaaaatttatgacaatgaacattaccagtaaacaaatggaaattactccggcaatccgccaacatgtcgcagaccgtctcgccaaactggaaaaatggcaaactcacctgattaatcctcatatcattctgtctaaagagccacagggctttattgctgacgccaccattaatacaccgaacggacatctggtcgccagcgcaaaacacgaagatatgtacaccgctattaatgaattgatcaacaagctggaacggcagctcaataaagtgcagcacaaaggcgaagcccgtcgtgccaccgcatcggtgaaagatgccagcttcgtcgaagcagaagaagagtagtcccttacattgagtgtatcgccaacgcgccttcgggcgcgttttttgttgacaggattaaaacagtacgggtactgtacttacgtacacaaaggaaacagttatgaagctcacccggtttttcttcgcattcttttttatcttcccctgaccgggaggcgtttcgtcatgtgataaagaatgcgaagacgaacaagaaggcctcccccaccgggaggccttttttattgataacaaaaaaggcaacactatgacatcggaaaacccattactggcgctgcgagataaaatcagcgctttagacgaagagttactggccttactggcaaaacgacgcgcgctggcgattgaagtgggacaagcaaaactactgtcgcatcgtccggttcgggatatcgatcgtgaacgcgcgctgctggacagactcatccatctcggtaaagcccaccatctcgacgcacactacattacccgtctgttccagcttatcattgaagactccgtgcttactcagcaggcgctgctgcaacaacatctgaataatactcaccctcattcggcacgtattgcgtttcttgggccgaaaggctcctattctcatctcgcggcgcgccagtatgctgcacgccattttgagcaatttattgagagcggttgcgcaaaattcaccgatatttttcatcaggtcgaaaccggccaggccgattacgccgtggttccgatagagaacaccaactccggcgctatcaacgatgtgtacgacttattgcaacacaccagtctgtcgattgtcggtgagatgaccgtcactatcgatcactgcgtgctggtttccggcgctacggatctgaataccatcgaaacggtgtacagccatccgcagccgtttcagcagtgcagtaaatttttgagccgctatccgcactggaaaatcgactataccgagagtacgtcggcagcgatggaaaaagtcgcgcaggcaaactctccgcgcgtcgcggcgctcggcagcgaggcaggcggcatgttgcacggtttacaggtgctggaacgcatcgccgcaaaccagacacagaatatcacccgctttctggtactggcgcgcaaagccatcaacgtttccgatcaggttccggcaaaaaccactctgttaatcgccaccgggcagcaagctggcgcgctggtcgaagcgctgctggtgctgcgtaaccacaatctcatcatgacgaaactggagtcgcgccccattcacggcaatccgtgggaagagatgttttatctcgatattcaggcgaacctggagtcgcaggtaatgcaaagcgcgctaaaagagctgggcgagatcacgcgctcaatgaaagtgcttggctgctatcccagcgaaaacgtcgtgccggtagaacctgcctgacgttcaataaaacggcttttcttcatccctgcgacggctacctgcagggtgaagatggcgccggagagcggataatccgccacttcctgagcagacatattttctctggtagttgtaataaacagcgttttcatatctgcgccgccaaagcaaaccatcgtcggacaacgtaccggcaaccggtactcttccagctgctctccttgcggtgagaaacgcgccacgcgccagccgtcaaacatcgcgctccagtagcacccttcgctatccatcgccgcgccgtcgggaagtccttctccttcgccaaaatggcgaaaaagttcacgcttgcccggttcgccatgcttatcaagtaacgtgcggtatatcacgccattcggcgtatcggaagtatacatccactggttgtccgggctgaacgccaggccgttgtgtccctggataccgcactggatcacttttgccgtcaggtcatgatcgatccgcatcagcaacgcgccattatagtcacccggcgcccagaacgttccggcataaaaacggccatcgccatcagtgccgccatcgttgaaacgcgccagtttcgtattagagggattgtcgcaaaccttacgctgcaataatccatttttatcggccagccaaatagcatgacgcatggccacaataaatccgccctgctcacgcaaggcaaaacagcctacctcttccggaaacgccagcacgctatgcgtcccactcgccggatggtaacgatagatctcctgttccaggatatcagtccaatacagcgcgctttcatcctcgctccatgtggggcattctggtaaatgtccgacataatcaaataaaaggtgcggcgtagtcataacggttccttaaacgaaaaaagccagcaaagctggcttttagtatagatgtcatcattatggtcggctgtcattcgcctgacgtaataacacacggctttcattctggaagcgtctggcataatcgccaaaccagtgttcaactttgcgaaaactgtcgataaaagcctgcttatcaccctgttccagtaacccgatcgcatcgccaaaacgtttatagtaacgcttgataagcgccagattgcgctccgacgacataataatgtctgcatacagctgcgggtcctgggcgaacagacgcccgaccatcgccagctccagtcgataaatcggcgatgatagcgccagaagctgctcaagctggacgttctcttccgccagatgcagcccataagcgaaggtagcaaagtggcgcagcgcctggataaaagccatgttctgatcgtgctcgacagcgctaattcggtgcaaccgcgcgccccacacctggatttgctcaaggaaccactgatacgcttccggttgacgcccatcacaccagaccaccacctgcttcgccaggctcccgctgtccgggccaaacatcgggtgcaagcccagcacggggccatcatgggccgccaacattgcctgtaacggaccgcttttcaccgatgccagatcgaccagaatacagtcggacggcaggggcggcagttgcgctatgacctgttcagtaacatgaatcggcacgctgacgatcaccattccggcatcggcgacaatgtccctggcgcgcggccagtcctgttgttccagaatacggacctgatagcccgacagcgtgagcattttttcaaacagacgccccatctgtccgccgccgcccacaatgacgaccggacgcagagaaggacaaagcgttttgaaccccttatcattttcgctggagtaagattcacgcattacccggcgcaggacatcttcaatgagatcgggcgggacaccgatcgcttctgcttccgcccgtcgtgaagccagcatagaggcctcacgctccggcacgtaaataggcaggccaaaacggcttttcacctcgccgactttggcaaccagttccaggcgcttagccagtaaattcaacaacgctttatcgacatcatctatttgatcgcgtaacgcggtcaattcagcaaccataacaacctcttatgcgacgcgcaccgccagctggccgctcaaatctttatgaatttcacgtaacagggcatcggtcatctcccagctaatacaagcatcggtgacggaaacgccatacttcatttcgctgcgcggctgttcggaagactgattaccctcatgaatattactttcaatcattaagccaatgattgaacgattgccatctttaatctgcgcaaccacagattcggcaacggctggctggcggcgataatctttattggagttaccatgactgcaatctaccatcagcgaaggacgtagccccgcctgttccatctctttttcacactgagcgacatctgccgggctatagtttggcgctttgccgccacgcagaatcacatggccatgcggatttccctgggtttgcaataacgcaacctgaccggcctggttaatgccaacaaaacgatgaggttgcgcagcggcgcgcatggcgttaatcgctgtcgccaggctgccatccgtgccgtttttaaagccgaccggcatagaaagaccagacgccatttcgcggtgggtttgcgattcggttgtgcgcgcgcctatcgccgaccagctaaacagatcgcccaggtattgcgggctgttcggatccaacgcttcggtcgccaatggcaaccccatattcaccagttccaccagtagctgacgcgctattttcaacccggcttccacatcaaatgagccatccatgtgaggatcgttaatcagccctttccagccgacggtagtccgcggcttttcaaaatagacgcgcattaccagatagaggctatcgctgacctctgcggcaagggctttaaatcgacgggcatattccagagcggtttcaggatcgtgaatagaacaaggaccgcataccaccaacagacgcggatcgcgcccggcaataatgtcagaaatgattccccgggactgcgctatctgcgcttcctgcgccaggctcaacggaaaggccgctttaagctgctccggcgtcattaatacctgttcatcggtgatacgtacgttattcagcgcgtctttttgcatgatggcgatcctgtcttttcttgtttgcgatagttgatcctccacgaggatgtttaaaccataccacaaaaagtaaagatttcaatccatattacgtaaaataaactttacatagtgctaaatcgtcgattaaacctctcaatttcgtatcaaaaactttacacaacaagtgaattattttattcccagcttcagaaaagcggtaaaatgagcgatgctcgctattttttgattattttttctccgcacgcataattttactttctgatatagggtgattaataccattatcacaagaatttaatatcagggatgccacttaaattattcatattatcaataagacataatgacgatatggcaaaataatgttattttgctacaaacaatcacggatgtattttaatgttttacgactgaagatggtggggacttgttaatgcgtttttctcaccgatttatccttctgttatcgctattattagcaagcttgcctctgtatgctcaatgtgtcacggaagaagagaaatccgtacgcgccattgtctccggtatcgtcagttatacacactggccagcgttatccgggccgccaaggctatgcatattttcatctgcgcgttttgtcagggtacttagcgaagaggctaactgggctttcccttatcaaccgcttgtcatccgtaccacacaagaagccctgagcgcccgctgtgatggtttttactttggcaatgaatcgccagcttatcaggtggagttaacgcgtcattatccagttaatgccttgttattaattgccgagcaaaataccgaatgtattattggcagcgcattttgtctgatcattaacaatgatgaagtcaaattttccgtcaacctggactccctctcgcatagcggcgtgagagtgaatccagaagtattaatgcttgcacggaatcaaaagcatgaataaggaattttctctgtccagaccaacatttaaacgcacactacggcggattagtataatcagcgtgctgcttacaatgacattgatctggctattaatttgcgttgcgtctgtccttacgctcaaacagtatgcgcaaaagaatctcgatttgaccgccgccacaatggcccatagccttgaagcggcactggtattttccgatagcgcggccgcagcggaaacgctcgccacactgggacgccagggacaattttcagcggcggaggtccgcgataaaaatggccgtactatcgcctcatggcgatatgatgcgcgagccgcagacgataagctcatcggcttaattagccactggctttttccattgccggtatcgcaacccgtctggcacaacggcagggctatcggcgaagtacggcttgtcgcccgcgacagccttattggtcattttatctggctatcgctggcagtgctgacaggatgtattctgctagcatccggcattgccctgctactcacgcgttatttacacaatggcgttgtggatgcgctacaaaatattactgaaattgtacacgacgttcgcactaaccgaaatttttcacgccgggtacctgatgagcgtattgcggaatttcacctgtttgcgcaggatttcaatagccttctggatgagatggaagaatggcagctacggcttcaggctaaaaatgcacaattactacgtaccgcgttgcacgatccgctgacggggcttgccaatcgcgcggcatttcgcagctgtattaacgcgctgatgaaggacaattccgctcgtagcagttcggcattgttatttctggatggcgataactttaaatatattaatgatacctggggacatgcggcaggcgaccgcgtacttatagaggttgccaaaagattagcggaattcggtggtagccgttatcagacttaccgactcggcggcgatgaatttgcgatggtgctttacggtgtacattcggagtatgaagtacaacgtatttgcgcagcactatcccaggcgtttaatcgaccttttgaactgcataacggccagcgaataacgatgaccctgagtattggctttgcgctgacatgggaacatgccactgccgaaaaactacaagaactggccgatcgaaatatgtatcaggctaaacaccggcgtgcagaacgctcgctaaactaaggaacgggccaggccgtttctgactcagcgttgataccacagacccagcttaatcatgcaaccgtctatggcgtggagcaacccataaaaaaaggggccagcgtaatgccagccccttcttttctacaagctttcggatgttgcgaaagcgcgttcttagttaagacgctctttgatacgagctgctttaccagtacgctcacgcaggtagtacagtttagctttacgaacagcaccacgacgtttaacagcaatgctgtcaactaccggagagtgagtctggaagacacgctcaacgccttcgccgttggaaattttacgaacagtgaatgcagagtgcagaccgcggttacgaatagcgataaccacgccctcgaatgcctgcagacgtttcttggtaccttcaacaacccatactttcacttccacggtatcgcccggacggaaggaaggtacgttctgcttcatctgctcttgttcaagttgcttaataatgttgctcataatttaatctcttatcctgggtaaactgatattcgggggcctatgccatcccatcatgtttatgctgctgttgtgcgtgttctgttttgaactccgccagcaaccttgcttgctcttcagtcagagccaggttttccagaagttcaggtcttctaagccaggttcggcccagtgactgtttcaaacgccagcgacgtatctcagcatggtttcccgacagcaatactggcggtacttccatcccctctaacacttcagggcgcgtatagtgcggacaatccagcaacccatcagcaaacgaatcttcgattgctgatgcctcatgccccagaacccccggtataaaccgggcgacggagtcaatcagcgtcattgccggtagttcgccaccgctgagaacgtaatcgccaattgaccattcttcgtcaatttcggcctgaattacgcgctcatctacgccttcgtagcgaccacacaccagaatgagtttctgattcgtggccagctcgctaacgcccgcttgatcaagcttgcgtccctgaggcgacagataaatcactttagcgccttcacctgccgcggcttttgctgcatgaatggcgtcccgcaagggttgcaccatcattaacatccccggtccgccgccgtaaggacggtcgtccacggtacggtgccggtcatgcgcgaagtcgcgaggactccagctttggatgttcagcaggcctttttttactgcccggccagttaccccgtaatcggtaattgcgcggaacatttcaggaaacaggctaacgatgccaataaacacaagccaatccccataacgccatttattaccgtttatccggtggtttaaaaaccaggatcccagtctacttcgatagtacgagtagcgagatcgactttcttgataacctgcccatcgaggaacggtactagtcgttccttgataccaaatgcatctttcaggttcgccttaatgacgagaacgtcattcgacccggtttccatcatgtcgataactttaccgagatcgtagccttcagcggtgactacctggcaacccatcaggtctttccagtagtagtctccctcctcaagcgcaggaagttgcgaggaatccacgacaatttcgcaattggtcagaagattcgcggcatctcgatcgtcaacgcctttcagcttgatgatcagatcctgattgtggtgcttccagctttccagctgtacctgctgccactgacccgccttctggataaaccagggctgatagtcaaaaatgctttcggcgtcttcagtggaggaaaacactctgagccaaccacggataccgtatgaagaacccattttccccagtacaaccggttcagcgggtacttgtgcggcgagttgcttgctcatcatgaccaccgtgacagattaagctgctttttttacttctttgatcagcgccgcaacgcgatcggaaatggttgcgccctggccaacccagtgagcgatgcgatccagatccaggcgggtgccttcttctttttcgctagcgattgggttgaagaaaccaacgcgctcaatgaagcgaccgttgcgtgcattacggctgtcggtgacaacaacctggtagaacggacgctttttagcgccgtgacgagctaaacgaatagttaccataacatcctcttgtgtgaataaaacaaccgggcctcatcgaggaacggagcccggcgtcatattaaaagcccgaaaattttactgatttctggggaaaatgcaatcagcatcttgctactgaacacgaaacaagggataaaaggcgtatatcggtgcagccagtttagctccggcgtgcgcgcagaaagcggagcgtacacgcagtacgtgagcatttcgagcacaccccggggctaaaatggcaaacaagatagccttatacccttgttttagcggccacgcagtacgtgaggatggctagcacaccccggtgccgaaatagcaagtgagcctagccgggaaattagcggcctggaaaaccaggcggcatcatccccttcatactccgcatcatcttcgccatcccgcccttcttcattttcttcatcatgcgctgcatgtcgtcgaactgtttcagaaggcggttaacgtcctgcacctgcatcccacagccctgcgcgatacgacgcttgcgggaacctttaatgatttccggcttcgcgcgttctttcagcgtcatcgaattgatgatcgcctccatacgcaccagcaccttatcatccatctgcgatttaacgttgtccggaatctgccccatgcccggtaatttgcccatcagactggccataccgcccatgtttttcatctgtttgagctgctccaggaagtcgttcaggtcgaaaccgtcgcctttcttcagtttggtcgccagcttctcagcctgtgcgcggtcaactttgctttcgatatcttcgataagagacagtacgtcgcccatgccgagaatacgcgaggcgatacgatccgggtggaacggctccagcgcgtcggttttctcgccgacaccgaggaatttaatcggcttgccggtgatatgacgaatagagagcgccgcaccgccacgcgcatcaccatcaactttggtcagcaccacaccggttaacggcagcgcttcgttaaaggcttttgcggtattcgccgcatcctgaccggtcatcgcatcgacgacaaacagcgtttctactggcttgatagaagcgtggacctgtttgatttcgtccatcatcgcttcgtcaacgtgcagacgaccggcggtatccaccagcagcacgtcgtagaatttgagcttcgcttctttcagcgcggcgttgacgatatcaaccggtttctggccgacatcagacgggaagaaatccacgccaacctgctcagccagcgtttcgagctgtttgatcgccgccgggcgatagacgtcggcagagacgaccagcactttcttcttgtgcttctcgcgcaagaatttacccaacttaccgacgctggtggttttacccgccccctgcagacccgccatcaatactacggctggcggctgcgcagccagattcagggtctggttttcttcgcccattgccgcaaccagttcgctacggacaatcttgacgaactcctgccctggggtcaggcttttgttaacttcatgaccaaccgctttctcttttacgcgattgatgaactcacgcactaccggcagcgcaacgtcagcctccagcagcgccatgcgcacttcgcgcagcgtctctttaacgttgtcttcagtaaggcgcccacggccactgatattgcgcagcgtgcgcgacaaacgatcggttaaattatcaaacattgtctctcgcctggggtggaaacggttggtcgccgcagcgacacagttacagaatttcgccacagtataccatgaagccgtctttgttgttatgcaacggttggagctgcggtcacgtaacgctatactgcttctctttctcactggtcaactgtcgacacaactatgcccgtttttgctttacttgcccttgtcgcctactccttcagcctcgcgctgatcgttcccggactgttgcaaaaaaacagcggctggcggcgtatggctattctttctgcggtcatcgcgctggtgtgccatgctgtcgcgctggaatcgcgtattctgcccggcggcgacagtggacaaaacctgagcctgctgaatgtcggttcgctggtcagcctgatgatctgcacggtgatgaccattgtcgcgtcgcgtaatcgcggctggctacttctgcccattgtctatgcttttgcgctgattaacctggccttcgccacgttcatgcctaatgaatatattacgcatctggaagcgaccccaggcatgatggtgcacatcggtctgtcgcttttctcttacgcgacgctgataatcgccgcgctgtatgcgctacaactggcgtggatcgactatcagttgaagaacaaaaagctggcgtttagtaatgaaatgccgccattgatgagcattgagcgcaaaatgtttcatatcacgcagattggcgtcgtactgctgacccttactctgtgtaccggcctgttttacatgcataacctgttcagtactgaaaatattgataaagccgtgctctctatcgtggcatggtttgtctatatcgttctgctgtgggggcattaccatgaaggctggcggggtcgtcgggtcgtgtggtttaacgtcgcaggcgcgggtattctgacgctggcctattttggtagccgcatattacagcaatttgtaagctaagcttttaaaggagtttcccctggaacacatctccaccaccacgctgattatcatattaatcatcatggtggtcatctcggcctatttttccggttccgaaactggaatgatgacgctaaaccgttaccgtttacgccatatggcgaagcaaggtaatcgctcggcaaaacgggtagaaaaattactgcgtaaacccgaccgactgataagcctggtgctgattggcaataacctggtcaacattcttgcctcggcgctcggcacgattgtgggtatgcggctttacggcgatgccggcgtggctatcgccaccggggtactgacgtttgtcgtgttagtttttgccgaagtcctgcccaaaactatcgccgcgctctatccggaaaaagtggcctatcccagcagcttcctgctggcgccgttacagatactgatgatgccgctggtgtggttacttaacaccatcacccgcctgctgatgcgtctgatgggaattaaaacggacatcgtggtcagcgggtcgttaagcaaagaggaattacgcactatcgtgcatgaatcccgttcgcaaatctctcgccgcaatcaggatatgctgctgtcggttctcgatctggaaaaggtcagcgtggatgacatcatggtgccgcgtaatgaaattatcgggatcgatatcaatgacgactggaagtctatcgagcggcagctcacccactcgccgcacggacgcattgtgctctatcgcgattcgctggatgacgccatcagtatgctgcgcgtgcgtgaagcctggcggttaatggccgagaaaaaagagttcaccaaagagatgatgctgcgcgccgccgatgaaatctattacgtcccggaaggtacgccgctcagtacgcaactgattaaatttcagcgcaataaaaagaaagtcggactggtcgtcaacgaatatggcgatatccaggggctggtcaccgtggaagatattctcgaggagatcgttggcgacttcaccacatcgatgtcgccgacactggcggaagaggtcacgccgcaaaacgacggttcggtcattattgacggtaccgccaacgtccgggaaatcaataaagcgtttaactggcacctgccggaagatgacgcgcgcaccgtcaacggggtgattctggaggcgctggaggaaattccggttgctggcacgcgcgtgcgcattgagcagtacgatatcgatattctcgatgtacaggaaaatatgattaagcaggtaaaggttgtaccggtaaaaccgctgcgcgagagtgtggcggagtaacacaatggcgaactccggttcgccttttttatcgccgtcttttaagattccatcaattcctgccatttacttaacaatgcaataatgtcttttcaggcattcagaaaggatattgatgttatgtcagaagattatgtaattgaatgggataagaattttgcagacgacctcaacgtcgtcgccaacgtttttttatcgcacaacccaaccttatggcccactattttctctcaactttcgacgcaacctgaaatctttgaagacgaagatgaagacgaatatgggttgcaagacgtcctggattgtagcggtggcgatctcggaaataacgagctggcacaggcatttttacaagttctacgcggcgaaggatttattcacctcgttgactggaaaggtgaagatgaagaaggcgaactggctaattttgccgcagatcgcttttatgaactcacaaaaaacctgacggattctgaggaattaagaaatcttcttgtcgaaataacccaagaggatgaaatctccgatgtctgtgaagccggggaccgttaccttgacgagatctttgaacgcatccagaccgaactcaataagaggggcttccagatttttgatctgaatgaaggatctgacacctataatgtggtcgttctgccaatgagcgaatataaaaaatagaggatttcaacacgccgtggctggaagtgcaggattttttaagctaaaaaaatggccgactttacatcggccattagacttttacttcgccttcgctacagtcaccatcgccgcgcgaatggtacgaccgttcagcgtgtagcctttctgcataatacccagcacattgcctgccggaacctcttccgattccaccatcgcaatcgcctgatgcacgttcgggtccagcggcacgttggtctcagcaatcacttccacgccgaacttacgcaccacatccagcatagacttcagcgtcagctcaatcccttcgaccattgccgccatatccggattggctttgtctgcgacttccagcgcgcgatccaggctatcgattaccggcagcaattcgttgacgaacttctcgagagcgaatttatgcgctttttcgatatcctgttcagtacggcggcgcaggttttccatttccgctttgatacgcaacacggtgtcgcgttcgcgagtctgggcttcggcaagctgaacttccagattcgcaattttttcatcgcgcggatccacctgctcagcagaatcgtttggttcaactgcctcaacctcttcgtgctgatccatgataatttcttccggggcttgcccctcaggcgttttctgttctttactactcatgaatttctccgcgttttttttcgcattcatctcgctaacttcgcttattatggggatcagattcagggtttcaagggaagtactcacattgtcatcaatcttcgctacaaggacctcagaaaaatgaataatcatttcaagtgtatcggcattgtggggcatccgcgtcatcccaccgcactcacgacacatgaaatgctctaccgttggctatgcgatcagggttatgaggtcattgtggagcaacaaatcgcccacgaattacagctaaaaaatgtgccaaccggcacgctggcggaaattggtcaacaggcggatctggcggtagttgtgggcggcgacggcaatatgcttggcgcagcgcgtacgctggcgcgttatgacatcaatgtgattggcattaaccgcggtaatcttggcttcctgaccgatctcgatccggacaacgccctgcaacaattatcggatgtgctggaaggacgctatatctccgaaaaacgttttctgctggaagcgcaggtctgccaacaggaccgccagaagcgtatcagcacagccattaatgaagtggtgctgcatccgggaaaagtggcgcatatgatcgaattcgaggtttatattgatgaaaccttcgctttttcacagcgatctgatggtctgatcatttctacgccgaccggctccaccgcctattcgctctccgcaggcggccctattctgaccccttcactggatgccatcaccctggtgccgatgttcccgcataccttgtcggcgcgcccgttagtcattaacagcagtagcacgattcgtctgcgtttttcgcatcgccgtagcgatctggaaattagctgcgacagtcagatagcgctgcctattcaggaaggagaagatgtgctgattcgccgctgcgactaccatctcaacctgatacatcccaaagactatagctatttcaatacattaagcacaaaactcggctggtcaaaaaaattattctaattttacgttagcctctttactgtataaaaaaccagtttatactgtatttaattacagtcatggtttttcatacaggaaaacagctatgttggcgcaactgaccatcagcaattttgctatcgttcgtgagcttgagatcgattttcagagcggaatgaccgtcattactggtgaaaccggcgcgggtaaatctattgcgattgatgccctgggtctgtgtctgggcggtcgcgctgaggccgatatggtccgtaccggagcgacccgcgccgatttgtgtgcccgctttgcgctgaaagacacgcctgcggcattgcgctggctggaagaaaaccagcttgaagaaggtcgcgaatgcttacttcgccgcgttatcagcagcgatggccgctcacggggctttattaacggcaccgctgtgcccctatctcaattgcgcgagctcggtcagttgctgattcaaattcatggtcaacatacgcaccagcagctgaccaaacccgaacagcaaaaatcgctgctggatagctatgccaacgaagccgctttagcgcagcagatggctgcccactaccaattatggcatcaaagctgccgcgatctcgcccatcaccagcaacaaagtcaggaacgcgccgcgcgcgcggaactgctgcaatatcagttaaaagagttgaacgactttaatccgcaggccggcgaattcgagcaaattgacgaagagtacaaacggctggccaacagcgggcagttgcttacgaccagccagaacgctctggcgctactcgcggacggcgaagacgttaacctgcaaagccagttatatagcgcaaaacaactggttagcgagctggtgggtatggacagcaagctttccggcatcctggatatgctggaagaagccactatccaactcaccgaagccagcgatgaattacgccactattgcgagcgtctggatttagaccccaatcgcctgtttgagcttgaacagcgcatcgctaaacaaatttcgctggcgcgaaaacatcacgtcagcccggaagcgctgccgcagctttatcagtcactgctcgaagaacagcagcagctcgacgatcaggccgattcgctggaaacgctgacgctggcggttaataagcatcaccaacaagcgctggaaacggcgcaagcgctgcatcaacagcgtcagttttacgcccaggagctggggcagttgatcactgaaagtatgcatttactttcgatgccgcacggtctgtttactatcgacgtgaaatttgatgagcatcatctgagcaacgacggcgccgatcgcgtggagtttaaagtgacgacaaacccgggtcagccgctgcagcctatcgctaaagtcgcgtctggcggtgaactgtcgcgcattgcgctggctattcaggtgattaccgcgcgcaaaatggaaacgccggcgctaatttttgacgaggttgatgttggcatcagcggcccaaccgccgccgtggtcggtaaactcctgcgtcagcttggcgaatccactcaggtgatgtgcgtcactcacctaccacaggtagccgggtgcggtcaccagcacttctttgtcagtaaagaaacagacggggcaatgaccgaaacccatatgcaacctttggataaacgtgcgcgtttacaggaactggcccgcctgttgggaggaagtgaagttacgcgtaatacgctggcaaacgcaaaagaactgctggcggcgtaaacttttttatctcccgaaggtctgagttcacaacaaaaacgccgtaagacccgacagcaaaaggttttaaagtgatgaaaggtctattatcatcggcatattaatatgagccacgtactgctcaggcccgaaaaggaacccaatcactatgcgctgtaaaacgctgactgctgccgcagcagtactcctgatgttgaccgcaggctgttccactctggagcgagtggtttaccgacctgacatcaatcaggggaactatcttacacctacggatgtcgccaaagtgcgtgttggtatgacgcaacaacaggttgcgtatgctttaggcacgccgatgatgaccgatccttttggtacgaacacctggttttatgtcttccgccagcagccaggacatgagaacgtgacgcagcagactctgacgctcacctttaacagcagcggcgtgttaaccaatattgataacaaaccggcgttgacgaagtaattttgtgataccgcctgatgaggttacgttcatcaggcctgcaaacctctcccccgccatttggtacgaatttgcctgatggcgctacgtttatctggcttacaggcacgcctgtgcttcaggtgtggtacggctttcacaccgttatccggcaaaagaggctaattatctgccagccgatttttcggcacgctggcggcgtaatgcttttggatcggcgattaagggacggtaaatttcaacccgatcgccatcctgcaccgtatcggtgagttttaccggacgactgtagatacctactttatttttcgccagatcgatatccgtgcgcaattccagcaagccggaagcgcgaatcgcctcttcgaccgtcgcgccctcctccagcgttacgcgctgcaaatactgcttttccggcagcgcataagccacttcaaccacaagtttatccagcacggtaaacctctttggcgcgaaccgtaaacgcctgcaccatgttggacgctaactctttgaatatacgaccaaacgccagctcaatgagtttattggtaaactcaaaatcaagctgaaactcaatgcggcacgcctcggggctgagcggggtaaatttccagccgccgatcagctttttaaaggggccatccaccagatgcatcagaatactctggttacgcgttagctgattacgcgtcgtaaacgtcttgctgatacccgccttcgacacgtcaacagccgccgtcatctgtgctggcgatgactccaggacacgactgccaacacacccaggcaaaaactggggatacgattgcacgtcattcactaactgatacatctgttccgcactgtaggggactaaagcagtccgactaatctgaggcatagcaattcccatcaacataaatcgtgtaaataataccacttatcagcgagtaaaaaaaatgctgtccccaaccgtcatgccttaattgtgcgtgcatagcccaactcatgctaagatagatttttgcacctcatcaggacgtaatggggtgttttcgatatcagattacctatgaattcacgacacttatgacgaagaaaaaagcacataaaccgggctcagccaccatcgcgctgaataagcgcgcccggcacgaatactttatcgaagaagagttcgaggctggtctcgccctgcaaggctgggaagtaaaatctctgcgcgcaggaaaagccaatatcggcgacagttacgttatcctcaaagatggcgaggcctggctgtttggcgcaaactttacgccgatggcggtcgcctcgacacatgtcgtatgcgacccaacccgaacccgcaaactgttgttaaatcagcgtgagcttgattcgctgtatggccgtattaatcgtgaaggttatactgtcgtcgcgctttctctgtactggaaaaatgcctggtgcaaagtgaagatcggcgtggcgaaaggtaaaaaacaacatgataaacgttccgatcttaaagaacgtgagtggcaactggataaagcacgcattatgaaaaatgcaggccgataatagacattttttgtgaccagcttctcagtatgaagctggtcaatgttcatatctcatgcatgcctcgaaaatatattctctgtgtctgacgcttatcaatagcaataaataccacaccacaacaagaatatattctttgtttaaaaaatttttatagcctaataacacaatacttcaaatgatttttataaaatttaatattgctgaataccttcacaaaaagtattgtttttatgttaaaagagaaaaagaagaaaaaattaaaattcattataaaacataaagataaataaaaaattatcatgcattgttagcccaccctacctctccttaacacaaactccgttatatttcagacgcactaacacctttatcaatagatcttaatttgcagaaagatttttttctgactatatcatctaatacgaaagcactagtcaggcacaaaaaacaaatggttattcgacgagaaaaccagaccttcacctacgctcataaaaaagaatatggctacggaaattcatctctcacgataaacgggaaggctcgtctacgcattttgccctgaacgtcgtgcccgttaattaatacacagagcaaatccatcaggagctaatttatgcgtctactcgccgtggtttcgaaattgactggcgtctccaccactctggaatcctcagcggtcactcttaacgcgccttcaattgttaaattatcagtggcccgggatgaaattagtcaacttacgcgcattaatcaggatctggtggtgaggctccattccggcgaaacgatcacgattaaaaacttttacgttaccaacgatctgggcgcaagccagctggtactggcggaaaacgatggcacgttatggtgggtggaaaatccgcaagccgggctacattttgaacaaatcgctgatattaatgagctgctggtcacttccggcgcttcccatgaagcaggcggcgccgtttggccgtgggtactggctggcgcggtggcggctggcggcattgccgctatcgcgtcttccggcggcggcgattcccaccatcattcggatggcgataatccgccccccgataacaccaatcctgacggtaatccccctgataacagcaatcccggcggcagtaaccctaacggcaatactccaggtagcagtaatcctgtagatactaccccgcctctcgctcccggcgaattattgatttcagcggacggaaaaacggtgagcggcgaggccgaagcgggcagtctcattaccatcaaagatccctcaggcaacgtcgttggcgagggcaaagcggatagcgacggtaaatttagtattgatctgacagcgccacagattagcggcgaacaacttaccgtgactgcgactgacgatgccggcaataccggcccatccgcaaccattgatgcgcccaacattcctctccccgatacaccggttatcaccgccgctatcgatgatgccgctcccctcaccggcacgctgagcaataatcagtttacgaacgacaatacccccactctggagggcaccggcagcgcaggcacagtcatccatatttacgccaatggtcaggaaataggctcaacaacagttgataccagcggaaactggcattttgccattaccagcgcgctagcggatggggaaaatcatttcaccgccattgcgactaacgttaaaggcgaaagtagcgaatcagcccgctttacgctgactatcgacacactcagccccgatgctccacgcgttgaactgatggccgataacaccggtttgctcaccggaccgctacagaataatgaccggactgacgaggcaaaaccgctattttccgggcagggagaggcaggcaataccatcacgattaaagagggttcaaccgttatcggcagcgctaccgtagacgaaaatggacgctggacctttacgccgactacgccgttaagcgatggcgaacatacctttaccgtcgaacagagcgacaaagccggaaacgcaagccgcgtgacgacaacgcctactatcattgtggacaccacgccgccggacgccgctatcattgataatgtcgcgaaagacggcacaaccgttagcggcaccgctgaagctggcagtaccgtgtcgatctatgacccggcgggaaattacctgggctccacgattaccggagaaaataaccacttcagcatcacgctgaatccggcccagacccacggcgagcgtctggaagcgcgtattcaggacgccgtcggtaacatcggccccgccacagagtttaccgcttctgactcacagtatcctgcccagccgactatccttaccgtgacggatgacgctggcgccgttaccgggctgttgaaaaatggcgatgccacagatgataaccgcccaaccctcagcggtactgctgaaccaggcagtacgatatcgattaacgataatggctttcctgttccgagctttccgcccattgtcgctgacgctgacggcaaatggagctttaccccctcgctggcgcttgccgatggcgaccatgtctttaccgctaccgcgaccaacgatcgcggcactagcgggcagtccgtcgcctttaccattgatatcgacacgcagccgccggtgctggaaggcctggcagttagcgacgtcggcgacagactcaccggcactacggaagctggcagcactgtggttatcaaagatagcctgggaaatacgctcgggagtggaacggcaggcgacgacggcaccttctcaataggtattagcccggcgaaaattaacggtgaaacattaagcattagcgttaccgataaagccgcgaatagcggtccggtagaaacgctgaacgcgccggataaaactgcgcctgcggcaccgaacggtcttatcgtggcgaccgacggtctgtccgtaagcggtcaggcggaagccggggcaacggtcactatccgcgacagtagcaataccgtacttggcagcgccgtcgctaacggcaacggacaatttatcgttccgctgaatgcggcgcagactaacggccaggcgcttatcgctaccgccaccgatatagcgaacaacgaaagcgccgccgcgacggtcgacgcgccggacagtaccgcgccagaaatgccgaaaaacgtggtaattagtgaggatggcgccagtatcagcgacaccgccgaaccgggtagctccattacgatcaccacgccggacggcacgccgctcggcagcggcaaagcagatggcgaaggtcattttacccttcccctcgcccccgcacagaccaacggcgaacaggttaccgtcaccgccaccgacagcgccaacaacgtcagcccgccaactacagcgcaagcgcccgatatcaccgccccggataagcccattatcacccaggtgctggacgatgttgaaagcttcaccgggccgctggttaacggacaaaccaccaatgacaaccgccccacccttagcggtacggcggaggctggcgcgcgtgtcgaaatttttgataacggcgtttcgctggggctcgccacgctacagcccaacggcggctggacgtttacgccgtcgcaaaatttaggtgaaggcgcgcatcgactgaccgtaatcgcaaccgacgctaaaggcaatgccagtccggcggggaacgaaagtccggaatccatcagctttaccctacgcatcgatacccaggcgccggatgcgccgcagatcgtgtcagccgccatcacaggcggagaaggcgaggtgctactggcaaacggcagtattaccaatcagcgtatgccgaccctcagcggcaccggcgaacccggcgccatcatcaccctgtacaataacggcgtagaactggctaccgtccaggtcaatccacagggtagctggacctatccgctaacccgtaatctgagcgaagggttaaacatcctgacggccaccgccacggatgccgcaggcaatagtagcccgacctccggcgttttctccgttacccttgatacccagcctccagcgcagcctgacgcgccgctaatcagcgataacgtcgcgccggttatcggcaacatcggcaataatggcgcaacgaacgataccacgccgaccttcagcggcacgggagagatcggcagcacgataattctctacaataatggcagtgaaattggtcgcacaacggtaggcgataacggtagctggaactttacgcctgcggcactgacgccagaaacctataccattaccgtcacggaaaccgatatagcgggcaatatcagtccaccttccgcctcagtcacttttacgctagacaccactgcgcccgccaatccggttatcacttttgccgaagataacgtcggcgaagtccaggatactattgtcagcggcgcaaccactgacgacaatacaccggtcattcacggcactggcgacatcggcagcgtgatcacgctctataatggcagtagtgtcgtgggcgtagtcaccgtcgatgagaccggtacctggacgctgccggtgaccagcgcgttgccggatggcgtctacaccctgaccgccattgccgccgatgccgccggaaacagcagcggcgtatcgaacagctttaccttcaccgtcgacaccgttccgttgcagccgcccgtcgtcaatgagatcctcgacgatgttgcaccagtgaccgggccattaaccgatggcgcctttactaacgatcggacgctgactattaacggcagcggcgaaaacggcagcaccgtcacgatttacgacaatggcgtggcaatcgggacggcgctcgttaccgacggggtctggacattcaatacgtccgaattgtcagaagccagccatgcgctaaccttcagcgcgactgacgatgctggaaataccacggcgcaaacccaaccgatcaccattaccgtggatatcaccgccccgcccgcgccaacgatccagacggtggccgatgatggcacgcgcgtcgccggacttgccgatccttacgctaccgttgaaattcatcatgccgatggcaccctggtcggcagcgctgtcgctaatggcaccggtgaatttgtcgtcacgctcagtccggcgcaaaccgatggcggtacgctgacggcaattgctatcgatcgcgcggggaataacggcccggctacgaattttcctgcttccgacagcggtctgcccgccgtcccggccatcacggcgattgaagatgatgtcgggagcatacaggggaatattgcagcgggcggcgccacggacgacaccatgccgacgctgcgcggcaccacggatatcggctctaccgttgaagttttcattgatggcgattcggcaggctttgccaccgttgacgccagcgggaactggatctttgagatcgcgacgccattaagcgaaagcacacattacttcaccgtccaggcaaccaatgcgaatggcccgggcggcctgtccgcaccggtcgggatcactgtcgatcttagcgcgccggcacaaccggttattaccagcgcaacggatgatgtccccggcatgaccggtacgctggataacggcgcgctcaccaatgattcacgcccgacgctcaacggaacgggagaagcaggcgccacaatccgcattctggataacggcgtagaaatcggttccgctacggtagatcaaagcggcaactggcgcttcaccccgaacacgccgctggagagcaacgcacacatctttaccgccgtggcgaccgatcccgccggcaatagcggtcagctttcggatggttttacgctgaacattgacgcgcaggcaccagatgtgccggttatcacctccgtgattgacgataacaatcaaccgaccgtcccggtgttaccggggcaatccaccgacgatcggcagccaatactgaacggaactggcgaacctggcgcgacaatcaccatttttgataacggtacgccgcttggcacggctcaggtaggcgaaaacggtagctggaccttcccggtgccccgcaatttgtcagagggaagccataatctgacggttagcgctaccgatccggcgggcaataccagcgcggtctccgcgccgtggacgatcgtggtcgatattacgcctccggcgatcccggttctcacctccgttgtggatgaccagcccggtattaccggcaacctggttagcgggcagctaacgaacgatgcgacgcccaccctgaacgggcgcggagaggcaggcgcgacgattaatgtctatcttgacggtaatcccgcgtccatcggtaccacgacggtgaatagcgacggcacgtggagtttcacgccgcagacgccgcttgcaaacggtagccacacgttcacccttagcgccaccgatccggcgggtaatagcagcgcggtgtccagcggatttgtgctgacgattgacaccacaccgcccgccgcgccggttatcgccagcgtggcagataatacggcgccggtaacgggcatcgtccccaacggcggctcgacgaacgaaacccgaccaacactctcgggtaccggtgaggcgggtacaaccatctcgatttataatggcagcgcgctggtcggcacggcgcaagttcaggccaacggtagctggagctttacaccgtctacctcgctgggcgcgggcgtctggaacctgacggcgacagcaaccgatgcggcaggcaataccagcgccgcgtccgaaatacgctcgtttactattgataccacggctcccgccgcgcctgttattgatacggtctacgacggtacgggccccattaccggcaatctgagttcagggcagatcacagacgaggcgcgccctgtcattagcggcacccgtgaagccaacacaactattcgtctctacgataacggcacgctgctggctgaaattcccgccgacaatagcagtagctggcgctacacgcccgacgcctcgctggcgacgggcaaccatgtaattaccgtcattgccgttgatgccgcaggcaacgccagccccgtttcggacagcgttaatttcgtcgtcgataccacgccgccgctgacgccggtaatcacatcagtcagtgacgatcaggcgccaggcctcggcacgatcgcgaacggccaaaataccaacgatcctacgccaaccttcagcggcaccgcagaagccggcgccacgatcacgctctatgaaaatggtacggtcattggcacgacaacggctcagcctgacggcgcgtggagcgtctccacctcaacgttggcaagcggaacgcacgtcatcaccgccgtcgccaccgatgccgcaggaaacagcagcccgaacagtacggctttcaccctgacggtcgataccaccgcgccgcaaacgccaatcctgacgtccgtggtggatgacgtcgcgggcggggtcacaggaaatctcgctaatggtcagataaccaatgataaccgccccacgctgaacggcactgccgaagcgggcagcgtggtcagtatctatgatggcgacactctgcttggcgtcacctcggctaacgctagcggcgcatggagcttcacgccgacgacagggttaaacgacggcacgcgcacattaacagtgaccgccaccgacccagcaggcaacgttagcccggccaccagcggttttactatcgtggtcgatacccttgcgccaacggttccgcttataaccagcatcgttgatgatgtcccgaacaataccggcgccattggcaatggacaatcgaccaatgacacacagccgacgctcaacggtaccgcggaagccaacagcgcggtaagtatcttcgataatggcgcgctggtcgcgaccgtgaacgccaatgccagcggcaactggagctggacgccaaccgcctcgctcggccagggaagtcatgcctatagcgttagcgccgccgatgcggctggcaacgttagcgccgcttcgccatcgacaacgattatcgtggataccattgcgcccggcgcgcccggtaacctagtcatcaatgctaccggtaatcgggtgacgggcaccgcggaagcaggcagcacagtgacgattacctctgagactggtgtggtactgggaaccgccaccgccgacggtacgggcagcttcaccgccacactcacgcccgcgcagaccaatggtcagccgctactggcatttgcccaggataaagcaggcaacactggcattgccgccggatttaccgcgcccgatacgcgcgtgccggaagcgccgatcatcaccaacgtagtggatgatgtgggtatttataccggcgctatcgccaacggtccggtcactaatgacgcacaacccacattgaatggtaccgctcaggcgggcgccacggtgagcatttataacaacggggcgctgctcggcaccaccacggcgaacgccagcgggaactggagctttaccccgacaggcaatttgaccgaaggcagccacgccttcaccgctaccgcaactaacgccaacggtacaggcagcgtctccaccgccgcgacggtgattgtcgatacgctggcgcccggtacgccgtcaggtacgctcagcgccgatggcggttcactttccggacaggctgaggcaaacagcaccgtaaccgtaacgctggcggggggcgtgacgctcaccaccaccgccggcagcaacggcgcatggtctctcaccttgccgacaaaacaaattgaaggtcaactcattaacgtgacggccactgacgctgcgggtaacgcctccggcacgttaggcattaccgcgccgattctgccgctggcggcaagggataacataaccagtcttgatctgacctctaccgccgtcaccagcacgcaaaactattcggattacggcctgctgctggttggcgcgcttggcaatgtcgcctcggttttgggtaacgataccgctcaggttgagttcaccattgctgaaggtggtacgggcgacgtcaccatcgatgccgccgcaacgggaatcgtgctttcgctgctcagcactcaggagatagtggtacagcgctatgacaccagcctcggcacctggacgacgatcgtcaacaccgccgttggcgacttcgcgaatttgcttaccctgaccgggagcggcgttaccctgaacctgaacggactgggcgaaggccagtaccgggtactcacttataacaccagtctgctcgccaccgggtcatataccagcctggatgtcgatgtacaccagaccagcgcaggtattattagcgggccaaccatcagtaccggcaacgtcatggctgatgataccgcgccgacgggcaccacggtcaccgccatcaccaacgccaacggcgtcagtacgccggtcggcgcgggcggcgtggatatcctggggcaatacggcacgctgcacattaatcaggatggcagttacacctacacgctgactaagcccacggcgggatacggacataaagagagcttcacctacaccatcacccagaatggcgtcggtagcagcgccgcgcaactggttattaatttgggtcccgcgcctgtaccgggcagcgtgatagcgacagacaataacgcctcgctggtctttgatactcacgttagctacgtcaacaacggcccctcgacacaaagcggcgtcacggtattaagcgtcggacttggtaatgtactgaacgcgaatctgcttgatgatatgactaatccgatcatctttaacgttgaagaaggcgctacgcgaaccatgacgttacagggaaccgtcggcggcgtctcactggtttccacgttcgatctgtacgtttatcgcttcaacgatgccattcaacaatatgagcagttccgggtgcaaaagggctggattaacaccctgctgttagccggacagtcccagccgctgaccctgacgttgcctggcggcgaatacttgttcgtgctgaataccgccagcggcattagcgtcctcactggctatacgttggcgatttcccaggaccacacctatgccgttgacagtatcaccgccaacaccaccggcaacgtactgaccaatgatgtcgcccctacggacgccctcctcactgaagtaaacggcgtggcgattgcggcgaccggcacgacggaggtaaatgggctgtatggctcgctcatcattgacgcaagaggcaactatacctacacgctgaagaacggcgtcggcgccgacagcattaaaacgccggacagctttatctatacgctcaaagcgccaaacggcgataccgatacggcctcgctcaatatcacgccaaccgccagggcgctggatgcgattaatgatgtcagcgatacccttagcgtcgccacgcttcaggataccgctgcctggctggactccagcgtcggcagcgccagttgggggctactcggcaaatcgggcagcgggagcggcacctttgacgttgcaacgggcaccgtacttaaaggcgcgtcactggtctttgatgtctccacgctcattacgctgggcaatctgaatattagctgggccattcaggagaacggaaccgtcatacgcaacggaaccgtcccggtggcgaatatcacgctgggcagcgcgacggtgaccgtcaacctgagcggcctggagctggatgccggaacgtacacgcttaactttaccggcaccaataccctggccggggcggcgacaatcacgccacgcgtcatcggcaccaccgtcgatctggataattttgaaacgtccggaacgcataccgttctcggcaatatttttgacggcagcgacgcggcgggggcgatggatcagcttaatacggtgaatactcgcctgagcattagcgggtataacggcagcgccgccacgctggacgccgcggcgaataccaccagcgccacgattcagggacattacggcacattgcaaattaacctcgatggcgcttacacctacaccctgaataatggcgtcgcgatgtcgtccatcaccagtaaagaggtctttacctatcaactggatgacaagataggtcatacggatagcgccacattgaccattgatatggcgccgcaaatcgtcagtaccaaccaaaacgatgttcttatcggctccgcctatggcgatacgctgatttatcacctgttaaacggcgcggacgcgaccggcggcaacggcgccgatcgctggcaaaacttctccaccgcgcagggcgacaagatcgatatccacgaactgctgaccggctgggatcaccaggcggcgacgctaggtaactttgttcaggttcataccagcggcgccaatacggtgatatccgtcgatcgcgacggcgccggcagcgcgtttaaatcaactgaccttgtcactttggagaatgtgcagctcacgctaaatgatctgttgcagaacaaccacctgataaccggcggttgataaaaagccccgaacgccacgacgttcggggcaacaagcggtgatatttaaaagggataaactatgggaagagtcgcgcctgtcgccatcgtactggcatttgctttgtttcatcaccagccccggggcgcagaagcgctgccaatgattacatccgaaggattagcaacggaccagatgcttccttcgctggatggctccgccgctgagttgccgctcagcgccgccgcgccgggcaacctgacgctcaatgacgcggtcaatcgcgccgttaactggcatccttctattcgcgaagccgtcggcaaactgctcgcacagaatgaacaaatagaggtcgccaaatcgaaatattatccgcaagtcagcgctggcgtgaacaatgggtacagcaatacctacaccgatcacgggtatagcccctcgctggtgctgtcggtatcgcaaatgctttatgacttcggcaaagtggcaagccaggttcgcgccgaaaccgcaggcgcagcacagcaacaggccaacgtgttgctcagtattgataccgtcgcgcacgaaaccgccaacgccattgtacaaacgcagagctggcagcaaatggtagaagcggcggaagaacagctcgtcgcgctggacagcatcggtaaacttatccggcagcgcagcgatgaaggcgctacgtcgctatctgacgtggtgcaaaccgaagccagaatcgaatccgcccgctcgcaactggcgcagtatcaggccaatctcgacagtgcgaaagcctcactgatgagctggctgggctggaattcgcttaacggcatcaataatgacttcccggcgaaactcgctcgcagctgtgagacagcgacgcccgaagatcggctggtgcccgcggtactggccgcctgggcgcaggccaacgttgcgcgggcgaatctggactatgccagtgcgcaaatgacgccgacgatttcgctcgaaccttctgtacaacattatcttaatgacaaatatcccagtcatgaagtgctggataaaacccagtattccacctgggtgaaagttgagatgccgctttatcagggcggagggctgactgcccgacgcaacgccgccagccatgcggtagacgcggctcagtcgaccattcagcgcacccggcttgatgtccgccagaaactgatggaggcgcgcagccaggcaatgagtcttgccagcgcgttacaaatccttcgtcggcaacagcagcttagcgaacgcacgcgcgaactgtatcagcagcaataccttgacctcggttcccgcccgttgctcgacgtgcttaatgcggagcaggaggtttaccaggcgcgttttgccgaactgcaaacggaaagccagttgcatcagttacaactgaactatctgtataacaccggcgcgcttcgtcaggcgttcgcgttaaatcatcgcagcattcaatccgtggagatccagccatgacccgcgccgcccccgatgtagaagaggtactcagtgagcgcgcgctaagccaatgggcgcaggccatcagccatgtcgccggtcattatcgcgttgcctgttctcccggttcaattcaggccaacgccccgtggtttaggggtaaaagcagaacgaccgccttaacgcagctcgcgcggcaggcgggtttatcctttcatgcgccggacatagacaaaacggcatttagtcagtggcgattgccgttggttgtcgagctccgggacgggcagttattggtcatcgaacatgttaatggcgaagatgcggtagacgtttttgtgattgaagaagagggtcagcgtaaccgcctgacgctcagcgagttattgccggagatcctctatgttgccgcgctacgcccgctatcggcgctcaaggatagccgcgtcgaccgctatatctcccgctttaaacccgactggatgcgcgagctggttctgcaggatattcgcccttatttaccggtaatggtcgccgcctttctgattaacgtgctgtctctggccgggattgtgttctctatgcaggtttacgatcgggtgatccccgctcagtcatatcctaccctgtacgtgctctccttcggcgtgctggtagcggtgctgttcggttttctgctgcgtgaagcgcgtacgcacattatggacgtgctcggtaaacgcgccgatatgcgcatttccgatcgggtattcggtcatgcgttaaggctgcgcaacagcgctatcccccgttccaccggcagttttatctcgcagttacgtgaactggagcagatccgcgagatgattacctcttcaacgctggcgaccattgtcgatctgcctttctttttcctgtttatgatagtcttggcgattattgccccaccgctggcatggatagcgcccgtggcggctctgctgatgatcctgccgggcgtcgcactgcaaaaaaaactggctgtcctcgccaaccaggccgcccacgaagcgacgctacgcaatgcggtcttggtcgaaagcgttcaggggctggaagatattaaactgatgcaggcggagaaccgctttcttcagcagtggaatagctatatccgtattaccggcgagtcgggtctacgcacccgcaaactcacgcaaaggcttatcagttgggggatgtcggtacaaagtctggtgtatgccgcagtgattatgttcggcgcgccgatggtcattgaaggcagtatgactaccggcgccgtggtcgccgcgtcgatgctcggctcacggatgatcgcgccaatggctaacctgtgcggcgtgctggcgcgctggcagcaggtgaaagcggcgaagatgggtctcgacaacattatgcaactgcccactgagacacagcatgacgatagcctgatacaccgcgacatcctccacgggcattacctctttgaaaacgctcagtttcgttaccataacgacgatcaacgcataccgctgcgcctcgtgcgtctggagatcatgccaggcgagcggattgcgatactggggcgtaacggtgcgggtaaatccacacttttacaggcgatggcgggcggcctggagatgattcagggagatgcccggcttgataatctcagcttgtcgcacatcgatatggcggatttacgccgcaacatcggctttcttagccagaacgcgcggcttttcttcggcaccctacgagagaacctgacgctcggcgcgccgcacgccaacgatgaacagatttttgacgcgctcgaagtcagcggcggcgccgtcttcgtcaggcggctggcaaaagggttggatcatcccattatggagggtggtaacggcctgtccggcgggcagcgtcagtccctgttgctggcgagaatgctgctgcgctcccccaatattgtgctacttgacgaacccagcgcctcgctggacgagcatacggaacgagagtttattcagcggttacatcagtggcttggcaaccgtaccctggtcgtcgcaacgcaccgggtaccaatactggagctggttgagcgtgtcgttgtcctgaaagaaggacaactggtgatggacgcgccaaaagcgcaggcgcttaacgcggatcggatgcaaagtcaccgtcgggagtagaaaaatgaaaatcaatcagcatgatgccgcgatggacgatttcgatattcagcgtgaacgggcgttttccggcgcgggtcgtattgttctgatctgctcactgttatttctcattctcggcatctgggcgtggtttggccgactggatgaggtttccaccggcaacgggaaagtaatccccagttcacgcgaacaggttctgcagtcgctggatggcggcattctggcgcagttgacggtgcgggaaggcgacagagttcaggctaaccagattgtcgcccagcttgatccgacgcgtctggcgtccaatgttggtgaaagtgcggcaaaatatcgcgcttcactcgcctccagcgcacggttaaccgcggaagtcagcgacttacctctcgccttccccgctgagctgaacggctggccggatctgattgccgcagagacgcgtctctataaaagccgccgcgcgcagctggccgataccgaagccgagctacgggatgcgctggcgtcggttaataaagagctgaccattacccagcggctggagaaaagcggcgcggccagtcatgttgaagtgctacgcctgcaacgacaaaaaagcgatttaggcttaaaaattaccgatctgcgctcacaatattatgtgcaggcacgcgaagcgttatcaaaagcgaacgctgaggtcgatatgctctccgccattttaaaaggacgcgaggattccgtcacccgccttaccatacgttcgccggtacgcggcattgttaaaaatatccaggtcacgacgattggcggcgtgatcccgcctaacggtgagatgatggagatagtgccggtagacgatcgtctgttgattgaaacccgcctttcgccgcgtgatatcgcctttattcatcccggccaacgcgcattggttaaaattactgcttacgattacgccatttacggcgggcttgacggcgtggtggagaccatttcaccggataccattcaggataaagtgaaaccggaaattttctactatcgcgtgtttatccgcacccaccaggactatctacaaaataaatcaggacgccgtttttcgattgttccaggcatgatcgccacggtggatatcaaaaccggtgaaaaaaccattgtcgactatttaatcaaaccgtttaatcgcgcgaaagaagcgctgcgcgagcggtaaatcgctgaagataagaagatacgggggctggtcacgcgtgtcacaagtctgttatacttaccttacacattggggctgattctggattcgacgggatttgcgaaacccaaggtgcatgccgaggggcggttggcctcgtaaaaagccgcaaaaaaatagtcgcaaacgacgaaacctacgctttagcagcttaataacctgcttagagccctctctccctagcctccgctcttaggacggggatcaagagaggtcaaacccaaaagagatcgcgcggatgccctgcctggggttgaagcgttaaaacgaatcaggctagtctggtagtggcgtgtccgtccgcaggtgccaggcgaatgtaaagactgactaagcatgtagtaccgaggatgtaggaatttcggacgcgggttcaactcccgccagctccaccacttgctcttccggatacgtccggagaaatcctgaaagcccgcatggcacaagctctgcgggcttttttgtgtctactgttgtccgaggatatccagctaaatccagtgattattggtatacgtttaggtatacggtaggatgtatacctaaatgcgtataccaattcatgaaggagcggccaaattggcaagaacgacacgccccctgaccaacacagaagtactgcgcgctaaagcgttagaaaaggatctaacgttgcatgatggcgatggtctttttctactcgttaaaacgaacggtaagaagttatggcgtttccgttatcaacgtccggcaacaaagcagcggacaatgatggggctaggtaccttcccagctctttcacttgctgacgcccgacggttaagagcggattacctttccttgttagccaacggaattgacccgcaaattcaagctgaaattgcagaggaacagcagcaaatcgcacaggacagtatttttacaacggtcgccgctaactggttccagcttaaaagcaaaagcgtaacccctgattacgcaagagacatttggcgctcattggagaaagatgtattccctgccgttggtgaactcccagttcagcaaatcaaagcccgaacgttggttgaagcgcttgagccagtcaaagctcgtggggcgctagagactgtacgtcggctagtgcaacgcattaacgagataatgatctttgccgtaaatacagggctgatcgatgccaatccagcttccggggttggaatggcctttgagaagccaaaaaagcaaaacatgccaacactacgaccagaagaactaccaaatctaatgcgttctttagccatgtctaatttatctgtatcgactcgctgccttatcgaatggcagcttctaacacttgtacgcccttctgaagcctctggtactcaatgggcagagatcgatcttgagaataaactctggacgatccctgcaggacgaatgaaagccaagcgagaacatattgttcctctgtcggttcgagcattagatattttagagataatgaagcctattagtgcacatcgtgaatatgttttcccaagtagaaataatcctaagcaaccaatgaatagtcagacagctaatgctgcattaaaaagaattggttatggaggaaagcttgttgcacatggtttgcgttctatagccagtacagctatgaatgaggaaggttttaatcccgatgttattgaagcagcattagcgcatagcgataaaaatgaagtccgtaaagcatataatcgttcgacttacctttatcaacgaattgatttaatgaattggtgggctaacttcgtgtttaaaaaaacacacgaatagcccacataaaataagaggctgctcaatgcagccattatttcaatgaattaatatacgtatttaatcctgttgattttataactcccatcacttctggtgattttttcaaataaacaacattaggccatgacagataagcaataataatacatattagtcgaaccattgcaaaatcagacagattaatgagagtttcaatatacatatgtttatcttgctcatcgaaaccattttcagttataacttcattatcaacaagtttaactgcaagataaaaccttcttgcaaatgaaaacatcttatcatcagatttatcatctaatgattcaattattttaatcaaagcatcttcagcaatacctctttgaatactggttttaatcagttgctcaagtttatttacagcattaacctttttaacttcaaaatcaccacttggagatggaaaaatcaaagagaaatcatcaaaagcacttttttgcgcgttaattaaattataaaattgaaattcaaatgacttccttttatcaagaaactcctgtcttttagtctcattaattaaacattcattcgcagttaattgcattttaactgatttaattagaagtaatattgaaatgaaactcaatataggattaagaacacctccaaaataatcaccaaactgtccccatatctctttgttttcagaaagagtggttgagcttccaccaaattgataatagtataatccaaagactactaatatcaaaatagatgtaacccaacctatatacctcataccccatccacctcaataattaagtatttcactacctcaccattactgatggttaaatctctaacttttaataacaaatactctcgctcttcttctgccagtctattgttagcatctagattactcgttattttcttggtctgggcatcagtaacgtattttagaccattcaaaaaaccaaaagaagtcgttttttcttcccccctgactaacagtctaccatttccagtaaaagtattaaacctagtaactatagcttctatctgatgatcatgattagtttcaattagctcagttatattcaaagcggtatttttgtttaaagtaattatcttttgcttctcacccggctttctataattcaaatcaactgaatagttgcacatggtggaaattttatgcatatttttaagtctatttcgaatagctttagtcaactcatcttcaatatcgtctaatccggaaaccactttttttgcagcgtcactcaatgccggaccttctaaaaaaagagactcataaatataataactcataacttctgcaaatacagtgcgagtcatacttgaaagacgcgctgcaacttttctatctgatataacaacatcaaatcgctgaccaaaagatcctgtaaaagaatgcttaaggtttgttcttatttcattagattgatgtctgttttctttaactttacctcgaagtattgcctctgtaataatactggtaactccagatgcacccaatagtgtctggagagcataatccatatctatttcatcgtcgccgctattgataaccaaatcaagactaactttcattatttccccacgaattgataaaaatctgctcaatgcataaaagtccatatttttatacagtaatcaaacttccaatgtctaaaatatgcaaacacattaaactaaatttatgatagtgatcaacatattgcgcgcagtgctttccccgcctcgcccgccagctttgcagggcggttttaatgcagttgcacagtcacgctcaggccgcgccgggaatggcgcggtctgcagaaaatgaggcaggaaaacgcatgcaaagccatgcaccttatcgatgcatggcttttttcagtaataacgggcggattttcggggaattttacacagactgacgtgatgccagttgcgcacttttacgcgaaaaaatcatgttctgcgcaggagtgaatttttcacggctgtcatccaccgaagccgcgtcaggcctgaatccgatggtcgttaaaatgtcactatcctgtgcggaataattaattttttcccccttcgcaagccaggacagaagggcttcacgcagggcatctgtggcacgctgtatggcacagtttcgggcaatggccgtcagctcactgtatcccatcagctccggtgccagtgccgccgccagtgctgtgccgtgctgctgcataaaatcattcagccggtcgcggatgctgatgtgctgaacggcttcatgcgaacgaatataacgaccggcggcctgattcacctgccattttctgacttcgataatattgcgtaattcgtccaggcgactgacgtttctgccttctcctgacagaagccgcagatattcctgttcggccgcagccagctcatttttgcgttgcagccatgctgctttgttattctgacaggtgtcaaaggcctgctgtaaggctgtgctttccatcgttatctctttctcatcatgctgaagaataaaaatacggtgtgcggcgacggccggtgttaaccggcagccctcattccagacgcagcgaatatgattgtgtttttaaccgtactggcggcagttcctgtttttcatgcaggctttctgccagttcgtccggcgtgaccgggcggacaatgaagcgggtgatggtctgaagcgttttaaacaccagaccacagcccggatccgtgcacacataaaaacgctcggtgacttcctgagacagacgtcgcgatgttcttgacagtgcaaggcctttacatctccgacaacaatatccggtaacaagcattcttttcgggcgtttcatactgccggaggctgacgtcagtgaatcgcggtatctctgtttgcctgaaatgtattccattcctgaatctttacagtcagagaaaaagctttcactcgcttcaaatgtcgcagagcaataaatattccggcactgtgcaatcattatcttggtgccatcgtccatgaaatgtgcgcgacgggtgtgagcaacatgtccacacgacgggcagtaaatcatgacagcagtcctctggccttaagcactgctccctgctggtctattttgtcctgccacaccttgcgctgtgccggtgtgcctgccacctcataatccatgtgcgggagtgttgccgctgacagtccggtcagccggagaaccggctcgccggtgaggctgatttgcatctgtttaattttctgttccagcgatgatttcacctgctgcatgacagccttttccggtgcgacatagccctgatggccggtggtgttggcgagcggattttcctgtaccaggatgctcagatgcattgcccggacaagcgcctcacaggtttcattcagggcgtgttccagctcatgctctgcatacagactcagaagatgatgatgtgccttccggtaggtggtggccgtgctgtcacacgcccctttcaggcgttcacgttcaaaattcagcaccacggccagattgtcatattcctgtaccagctcccggcgtgccacgcgctcaatgtggcgctgtttcagctcgtcgctcaggacaccaccggctgcacgaaaggccgtgcgccagtcgtcagcatcgtttccgtcggcctgcgtcagcgcatttttttcctgctctgcccgttcaatggccgtgacggtctcatccatcaggcgggcgttctcaagatgagcgactctggccttttccagttgtgccagtgcgggttgcagatattcagggatggtgttgtcagacattttccggctcctcgtcacttcaggttaagaaaattgtgacgtacaccggacaacaacacgacgcattgcagatgtgccagccctgacacaggagactcatcctcagaccggcaagccaggaaaaggtcgcaggaaaaaccggcttactgtttgtttttttatattttactgttcacctctgttcaccataataaaaaagataagtaatacagtaagttaaagggtgaacaatcgcagtaatgactgttcaccgtctgttcaccactgttcacccgttgatgggctttttgtgctgtttattactttttatttttattaattcactgaaataaataagaaaaaacaatttgtatttcactataattttttccagctccttccagagcgttttaaagctatctggcgctgatgtacaaaaaatgcacagccattgtaaggctgccggaacaaatcccccctgttgcgtctgccaaaaatattcacaaaataaagcgctacccgaagccggacggacttatccggtgctgtatggacattaacgaggtagcccgatgcaagctgttttttcttccccgtctcccgcccctgtgacaccactgatgccgctgccggacatcacgcaggagcgttttttacgtctgccggaagtgatgcacctgtgcggcctgtcacgctcgaccatctacgaactcatccgtaagggggaatttccgccgcaggtgagtcttggcggtaaaaatgtggcctggctgcactctgaaatcaccgcatggatggccggacgcattgccggacgcaaacgggggtacgacgcatgatgatgcccgctctgcaaaaactccctttttctggcttgcctttttccggcatttgcggatatagtttttccgctgccgcaaaatcggcagccgggcgtgagaacccgagtatgttatcggcgacatatgacgcgccatgcgtctttttttgtgtcgcaatcaacgccacagagcgccagattatggtgtggcgtgtggtttgccgtgcaggtatgatcctgttcgcaatcgcatgttatgccactgagtcaatggtagctcaggcggggcagcctccgggctggccggtttccgataacgccggtattctcacccccgtctgggctatcgccatcgagcgtgagaactccggcgatagcgtcatttacgctgttatcggaggttgccttatggctacgacccttaccccctcacatcctgaatttgtctttgtgtttgcggctgtccgtcgcgcagaccgtcatccccgtatctgcatgcttcgcaccgtcgccggtgatgaacgcagcgcccgccgttcccttgtccgtgactatgtgctctcccttgctgcccgtctgccggtggtggaggtgtcccgtgcgtaataaaaaagcccctcagaccgtctcagcgcgtcatgacgcccgtgaacacctcagcattgaggcttaccataagctcaaccgcgccagcgccgtatcccagtttgttgggggtgatttgattcaccgtgaactctccggcctgcatcagctctacattccgcatattttcagctacctgaatgaagatattgattttgtgctgaatgagctgaaagccaaaggcctgtgccgcgattttctcgcccagcagaaagaccggggagacaggacgcatgtttgattttccccagcccggtgagatttaccgttctgccggttttcccgatgtggccgtggtcggcattctggaagacggtattccgtgggaaatgccgtaccgctgcccggacattgtctggaacccgtaccgccgtaaattcagtatccttgtgcgtatcctcgctgacgggcgcaccacagacatcccgctggggcgttttctgcgggaatttacctgtgaccgtcctgacctgtttaaacgcagccccgtaaaccggcatgcggtactgaaagaaatggccggagacccggaattacagaaatggcgggagaaatatctggatatttacccgcaggacactgttccggtcagccgggcagcaccggtggcgcgggaatggcgggaaattccccgcacggagcctgacccggaaaccaccccggataacagttaccgcaattatctgtaattaaaaaacgacacccgaaaaattaaatgtgcgtattcgcgcagggatacgcacgtcttcaggagacgcagatatgccttatcagttaatggaaccggcacggaatgcagtcatctgtcacagggaggaaagcaaatgaaaacacccttaccgcccgtcttacgcgctgccctttaccgtcgcgctgtcgcctgtgcctggctgaccgtgtgcgaacgtcagcaccgctacccgcatctcacccttgagtcactggaggcggccatcgccgctgagctggaaggcttttatctgcgccagcacggtgaggaaaaagggcgtcagatagcctgtgccctgctggaagatttaatggaatccggccccctgaaggccgcgccgtcgctgtcctttctcgggctggttgtgatggatgaactctgtgcccgtcacataaaagcgccggtactgcactgaaggagaacaacaccatgaaaatgaacgtaaccgccaccgtcagccatgcgctcggccactggccgcgtattctcccggcgctggggattcaggtgctgaagaaccgtcatcagccctgtccggtctgtggcgggagtgaccgtttccgttttgatgacagggaggggcgcggcacctggtactgcaatcagtgtggtgccggtgacggcctgaaactggttgaaaaggtgtttggtgtttccccgtccgacgcggccgcaaaggtggctgccgtgaccggcagtctgcccccggctgacccggcagtgacggccgccgccgttgctgaaacagaagccgcccggaagaacgccgccgcactggcacaaaccctgatggcgaaaacccgtcccggaaccggtaacgcctacctgacccgcaagggctttcccggccgggaatgccggatgctgaccggcacacacagagccggtggcgtgagctggcgcgccggtgaccttgtggtgccactgtatgacgacagcggcgaactggttaaccttcagttaatcagtgctgacggccgtaagcgcaccctgaaaggcggacaggtcaggggcacctgtcacatccttgaaggacagaatcaggccggaaaacgtctgtggatagcggagggatacgcgaccgcacttaccgtacatcacctgaccggtgaaacggtgatggtggcgctttcttccgtgaacctcctttctctggccagccttgcccggcagaagcaccccgcctgtcagattgtccttgccgcagaccgtgacctcagcggtgacggccagaaaaaagccgctgcagccgcagatgcgtgtgagggcgttgttgccctgccgccggtcttcggtgactggaatgatgccttcacgcagtacggcggggaggccacccgtaaggccatttacgatgccatccggccaccggctgaaagcccgttcgacaccatgagcgaagcagagttttccgccatgagtaccagcgaaaaggccatgcgtatctatgagcattacggcgaggcgctcgcggtcgatgccaacggccagcttctgtcccgttatgaaaatggtgtctggaaggtgctgccgccacaggactttgcccgggatgtggccgggctgtttcagcgtctgcgcgcgccgttctcctccgggaaggtggcctccgtggtggacaccctgaagctgattattccgcagcaggaagccccctcccgccgcctgattggctttcgtaacggcgtgctcgacacgcagaacggcacgttccacccgcacagtccgtcacactggatgcgcaccctgtgtgatgtggatttcaccccgccggtggaaggggaaacgctggaaacccacgcccccgcgttctggcgctggcttgaccgtgccgccggtggccgtgcggaaaaacgcgacgtgattctggccgcactgtttatggtgctggcaaaccgctacgactggcagctctttctggaggtgaccggtcccggcggcagcggcaaaagtatcatggccgaaatagccaccctgctggccggggaggataacgccacgtcggccaccattgagacgctggaatccccgcgtgaacgtgccgcgttaactggcttctcactgatacgcctgccggaccaggaaaaatggagcggcgacggtgccggactcaaggccatcaccggcggcgatgcggtgtccgtggacccgaaataccgggatgcgtactccacgcatatcccggcggtgattctggccgtgaacaataacccgatgcgcttcaccgaccgcagcggcggcgtgtcacgccggcgggtgattattcacttcccggaacagatagccccgcaggagcgcgacccgcagcttaaggacaaaatcacccgcgagctggcggtcatcgtgcgtcacctgatgcagaagttcagcgacccgatgctcgcccggtcactgcttcagtcccagcagaactcagacgaggcactgaacatcaaacgggatgccgacccgacgtttgattttatcggctatctggaaaccctgccgcagaccagcggcatgtatatggggaacgccagtatcatcccgcgtaattaccgtaaatacctctatcacgcctatctggcctacatggaggcaaacggctaccggaatgtactcagtctgaaaatgttcgggctggggctgccggtgatgctgaaggaatacggactgaattacgagaagcgccataccaaacaggggatacagaccaacctgacgctgaaagaggaaagctacggcgactggctgccaaaatgtgacgaccctgcaacaacctgaccctcatgactcatctgaccggcatctgccggtctttttttatcccgatatcccccgcaggtgaacaatccactgttcacccttcaccgtgtattcacccgttatcacactgaaattaaaagagaaaaacgaaaggtgaacagtgtgaacaatcaaatcaaaaaaaaacttttttctccctgtgtgatttcagtgcggatgattaatcaccggtatgagtcacaccggcagaatgccggaggtgaagaatcgaatgttcacccttcacccattattcaccacctatcactatgaaataaaaggagaaaatagaaaggtgaacagtgtgaacagttctttcgaaaaaaaattttttcctgtacgatatagcatcaatccaagtaaaaatgcgctttcatttcacattaacttacagccattggtatacgattaggtatacgcacaaaaactgaattaaacaaaatcattaaaaatcaaagcaatacaatatttattcaaactccgccagcccaccaaataaatcaaggggttacgtgaaagcgtagcccttttttctttggtagtggcggcaaaatggcggcaggcattcagtcaagcccagttgctactacatgcgatcgcaattacaacttaaagagtttcgcttgccctggattaacagcttcgacgtagtttttgacccctattctgtgcggctcataattgcttgaatagaaatcaatcaggaagtcactcattttctgagatgtgactttcataactcccttactcaaagttaaattaaacacgctaatctttgacgatggtgcctgagttttactcatgttggcttgataaccagatttacgcattgccactagtgcttcgtcgtaagccgcttgtaattgggccaaattgtttgacgagatgatcacatcatccataaacacacttagcttgagatcatgatgtttgttcaatcggcgtagtaagctaccaaaataacttttatctaagcagagggttgcaagtattggagattgaacaaaaccaaaagggaggacatgcttatgtggactatgggacaagtttcttacagttgaaaatgttgagatttcccgcgcttgagaataggtgaagtagctctttagatcacgggtgatacgactacggctcgttgactgaaaaaattgtttaatatcaacaacggcaaaaaaatcactttttaagtgtaatctggcagctttaagatgcccaccagttcttagatggtaaaaatagagtggcggaatccacttgtttctgacagcctgaagtatcttccctccgactttacgtgcctcaacgcttgggacataaacccaaaccccgggcttaatctcaaatttatcttcccacctttgaacttctattgtcatgagttaaattgttgtagttgaaggccatgttaagaacggcgtaaaccgcaccaactaagccaacaaacgcggttgcgcatttgagcatagcggtgatcagttcaacacgcgccttaactaagccaagttcgtttgtatccataacttgttcctccatagatacctgacgtctcttagcgcaagcgcatggccctaactaaataaaaaataacaaccagttagcccagaaagcttaacaagtcggcgtccgattacatggcaaccaggtaatcggtccgcagtcgcaaagcgacaaactacatatctacggagtggggataaatccccgctaacgtcaggcattgttaatttaacctcaacttatagaaaagtatagttttaaatcatgtagttatgtcgccatttaaatcggcaaacccacctgtttaaatttatgaggatgcggctgaaccggatttgactcttttggcgttgcaatcgaacgaacaaaagtttcatgggtaacaaaagtatggctgcagttaatgttctggcactggttgtaacgctctttggtcaatgaagatacctgaaaactgctgcgagtatgggcggcacttccacacagtgggcaaatcatcatttttcgagctctccccatttttgctaaattcacaataatgataccgcattattccattttgcaaacttaaaagttctccattgcgaagaatcattccatttcgaaatcatcaatcctcacttcaagctccagactggtcgtaaaaccattatccgggctgacagtatgtgtcagggtggtaatggtccattccgcatcatctatcggctgtttaaagccactgaccttcacaggcatttccgtgtagagatctgcccgaccttccgccagttgtagcgagaatgacgcaacgccgcgttgcaagcgttcccactgcattttcgccgctcgttcggcgttgctccggttggcataagtgcgattaagtaccagcacgttttcatccgtccccaccaggtaatcgccctgcttcgcttccggctctttcttctgcttcttagtcctgcgcttacgcttcaccgtggtgctttctttcttcgcgggttcgcgggtatgcaaccagctggcaattacgcccgtgtaggctccgcgatctgccagggtaaagcggtgactgtcgccgtccttccgtgtgatagtgatcaccggcagtggtttaccgctggcgcttttaccctgtccctgccggatgaataacagattgccatttttcaccgacgcaatagcaccgtactggcgcgccagccgcatcagaaaactgccgtcactctcattggtctggtctatatgctccacgggtttatccgacaggtcttcacccaatgccatcttcagtttgtgccgcgcagctatttccttcaccacttccccaacggtggtcttgtgccacgatttttcacggcgggtattcagggtttcacgaaaatcagcacttcgcgcccggatagtcaggcggtccggtgcgccagtgtgttcaatctcgtccaccgtgaatgctcctttcgggaaaagcggctgccccttccagcccaacgccagcgtaatgacagccccacggcgcggcagcacgatttttccgtcggcgtcgtccagctccaaatcaagctggtctgcttcaaagccccgattgtccgtcagcgtcagactcatcaggcggttatccagcacagtggtgatatccttcccctcaatactgatgctgaatgcgggagttttgttgcctttgttaagcagttcagagctgaaattcacgacagcagccctcccaccgttttactgatatcgcttaaggcagacgttaccgtatcctgcaaattattcagctgcgcactgagatcaccgaacatatcggacagggattcatccacccgtttgagcgacagggtgaactcaatccggcgcggcataccatcgcggaaaaactccgttttagtctgattcagtccctcaatcacatacatgccgtaaatcgtgccgctgccttcaatcaggggccatgcttttccctgttctgccatctgctccagagccagcaacgacagtctgccgcccgttatctccggcataagaacaccagaaagcgtcagcatgtcgttgtccggtcccagaaactgcgtggatggacgtcggttgacccggctgtttgccgcatgtcgccagctgcgttgatacagcagttcctgatacggcacagtgcgcagcataaacacgtacaatcccagcaccatcatcatgcgtcgtatcccccctgatcgctgtagttactcctggcttttgccttcagcctgcgttcacgttcatcaagctggcgggccacctcccgcgcaatatcctgcacactttgtcctggctgcgtctgaatgatgatctgcgtcggtgcctcaatccgttgaacgggcgacacagtggctgcgcgactcaccatcgcttcaccgcctttcgcgggaaatgccaaagggtgcaacggtggaagctctgctggcgcggcagcaacacccatcattccggcaacaacggcagccagtgcagctgtatttctccggctggtcacgtttgccgggccgttgacaatttcaggcccgttttcaccgacaatgccaaactgcccgcgcgggatatacccaccgctgtcatacatccccgcaaaaccatatccccatgatggaaaaccacctgatggcatcatcactttaccgtctgcattcaccgtcgcaggttgctgacgcgtcacgctttccggcagtttcgcctttgcagcctctttactgacaataccgagtttctccagcaaccaggaaacgccggatttcagggagtccagcggatgcatgaccatattcagcccttccgccagtgcctccccgaatcgtcgccccattgccgctgcgctctgcagttcggcagaggtcgacttaacgggcgtcagcagatcagtaaaccagccccacaacgcctgcactttgtcgccaatccactgaaacacaggcttaagtggttcgaatgctgcactgatgggacctgccgccgctttgaatccttccaccacgccaccgagaaatgcggtgatgggttgccagtatttccagacaaccagcgccacgcccgccagtgcagtaaccacaagacctatcggactgagcagagcacctaacagaccagatacggcatacagggcaatgcgcaacatcgccagcgggccggatgcgagcacacgcagcaccgcgcctgcggcagccagcccaccgcgtagtgctgccagtggattcataaacatcacagcaacagcacgtaaaccggataatccagaccgcaaaagtgcaaccggcgcacctgctacagttttcaggacattccccgtcagtgatgccgtgcggcgcaaagacgacaacggcgcagtaagtaaacccgcagcgttgcccgatgaagcaagcccgcgtcgcagcagtgccagtggtgcgccagccagccaggacaacgcgctgctagttcgggttactgctgccgtaacggaaggtaacgttttgatacccagcacagagaaccccagacggatgactgccagcggccccagcactgcagccagcgccaccgctaaggtgccgaggcccacggtaacggcagccaccacagcggctactttcatcagtgtgcccgtcagttccgggttagcttccacccaacgacgcgatgctcccgtgacgcttttcaccatgtacagaatatccatcagcggctggcgcagcgtttcgcccaggctgctgaaggtgttctgcgctccggttttgaccagcaaccactgcgcagaaagtgagtccttgttaatgtcggattctttctgcatggagccgagcgcatcattgcccgctgtcagttttagctggcgctgcagttccggcaggttgtttgccagtttcgccgcgtcatcgccaaactctttaccaaacaacatggtcatggcagacagacgcttgtcctgcggcagtgcgttcaccttctccagcacacgctggatagttcccatcgcatccttcgtcatctgcttttcaataacttcaggattgagtttcagcagattcatcccttcaaagaaactcttgctttgcatggtggcaatggacaattcacgcaccatcgcgtttgctgcactggctgcaacctccggcgcagcgcccagtgtcagaaaggtggaacccagcgccgccgctttacgataatccagacggtcagccacaccgcccagacgttgcatgacatcaataatgtctgcccctttcgacatggcgttatcatccagatagttcagcgcatcaccgagctgttcaatattgcgggtagggattttgtagagctgggcgattttccccagactttctgacagttcatccgctggcagctcaaaggctgttgccgcctttgctgccgtactggcgaaggccagcaggtcacgtttctggtcttcccagctgtcgtcagggtttgcgacgttcatgcgcgcaccaccttcaaccagtgcagcgaagtctaccgcaccgttttccatcggcaactgttcgctggcagccttgatggcatcctgcatttcataaaaacgtgcagtgcggttgccattatcgtcacgcagaccattgacctgctttgccacacctttcatggcatcttccatgctggtatagctttttactgccgccatcactggcgtccccattgccagccctgccgccgtggtggtggctccggctcctgcgatgcgatcgcgcacctccagcgaacgggcataactggcacgcgccacattcatcctgcgctgagcttcccccagtcgcttcagccgcgcctcctgtttcgacagttcctggttataacgtgatgtttcacgggctaaacgggcagttgctcccgcatcatctttcgcagaaattcccgcccggtacagttcagcacgcacaagcgccgtctgctgctgcagctttttctggcgttcttccaggcgctgaacagccagccgttgacggcccagagcaacaacctgacgttgcgaaggcggccccatcgctcccagttcctgactgagcaaatttgcacgctggcgggcatagttcagcctgtcgcctaatttctgattttctgcctgcagctttcggaagctgtccagactgctcccggcctgatcaagctgctttattgcatcgcgggattttttgacagcagcagccagttctcttgaactggcctgcgcagatcgaaatgggcgggtgagcttgtcaaccgcattaagaatgacctgcagacgcaggttgttatcactcatcgttggccccgcttctctgaatcgctttataccgccattccagcacttcggtcagcggcataacgtcagtaacggatggcggccagtgaaaaatggtggcgatatctgccaccagatcgtcaaccgtcaggctgtcggtaaaccggcaagcaccgacttcttcaacaaaaaagtgacaacctcaaccgacatggcagtgagatctgccgggtccatctctgcaatttcctgtgcagtcagtgccgggctggagatgcgggggatcacggtcatcatcgcgttcacatccatatccataatggcctgcaggcgtgtaccgcgcagcgcaccggactgcggtttacgcagcacaatttcggtgatttccgtttttccgcgcttgatgggagtatccagttgaatggtcttttcagtcttcttatcgctcattttgctgtcctgtaaattgggttctggcgcggtatcccacgccgttcagatacatcagaggccgagggcgttacggtgcgcttccatcaggtccacaccgtccacaatttccaccatgttgatcaggtccacttcatagagcacctcaccattgatggtcagcttcgcgtagctgttggtactggtcactttggtggtgttgctttcgcccgtcttccactcgccggaatccacttctttgtgacgtccacgcaccacaagctccacggcctgcacttccccggtatcatcacgctgaatagagccggtaaagcgcagctggatgccatccaccgtggctttgcccatctgcttaaacagcagcagctcagtaccaccaatggaaaattccgtatccagtgcgccgtcatccagccccagatccacatccactgcacccggcattccgccgccgcgatacttctcatatttgcgggtaaatttcggcagcgtcagcgactcaacgatcccctgccagttgttcccgtcattaaacaggttcaggtgttttaatttgcgtggtaaagccatgttgtccccttacgcgctgacctggctggagaaattcaccaggtactgatcggtgatgcgctgacgcagcatcaggttttcaagtggcggcactggcgtgtagtcgtagtcgatggtgagttttccggctttcagcgtgtctttgtcgttcaccgactcatccagccagcaatcaccaccaatgagatagccctgactgaccaggctgcgcattttggcgcggataccctcgataatgtcgcgggccagcgacggattcagcggtttatccaccgcccacatgtgcgcttctgccatcgtgtccgtcagcacctgcgccgtgcgggtgtagttttcgaaggcaaagagcgggtcatcactcaggcagcgggaaccccagaagcggaaaccgtctttacgcacaagcgtggtgacgtcgttctggttcagcagtcccgcatcggttgccgggtcctgcagatcccagaacacatcagcagaaattccggtgacaccgttcacgcccacgttggacaggcttttgtgccatccggtctgctcgtcaattttggcgcgcagaccaagcgcacgggcggtggcatatgccgttgcttcggcattcagcacagtgtcccagccagtaaagtcaggccagatcagcatcccttcgcgctggctgaagttttcacggtaagtgatcgcctcctgtaccgtcttgcagccatacgctgacaggtaagcaaatccacacaggctttgcgccacgctcagcaactcagtagctaccgccttggtgtcgtggcctggcacgccgagaatgcgcggtttaacgccaaactgtgactgggcagataacagggctttcatgcctgtttttttaccttcagcggtcactgcgccgatgatattggtcgtggtttcttcttccgtttcaccctgcggcacacgcacaacaacggtcacgggttttgcctggtcagcgatggcatccagcgaacgggccagcgtgcctgactcacccgctttaccgctggcagtcagcacatcagtgatcagcacgggtttattaagaggaaacatttttgcatcggcatcatcgcccgtgcagaccatacccacgatggcggtgctcaccgtggtaatggatcgggtgccttcgttgacttcaacaacgcgcaccccgtggtggtaatcctgagccatagtggcgaacctcctgattggattaggcttcgccctatgttgaagtgattgtgtccgacaaacagctaagcgcagttgtaccgttattcacacaaaatgacggtatttgtccgcttgcaggaataatcaaaataatgctgattcagggagatttattgttcttatttgccggaaattttcgataaatgatagaaacgcctacatcaaaaatcagtgcaatacgctgtcttgattctccggcctcgagtaaacgcccaatctgtgcccactgttcgctggtcaacttaggacggcgtccacctactctgcctttagcacgagctgcagccagccctgccctggtacgttcaactatcagttcgcgttccatttcagccagggcacccatgacatgaaaaaagaaacggcccattggggtgctggtatcaatactgtcagtcaggcttcggaaattcacgccacgctggcgcagctcttctatcagcgtaacaagatgccgcatactgcgccccagtctgtccagcttccagacaaccagcgtgtctcctgccgatagtgtcctgagcagctttttcagccccggtctgtcggacttggtgccactgattttatcctcaaaaatccgctcacatcccgcgcagttcagtgcattgcgttgcaaatcggtgttctggtcatttgttgacacgcgtacatagccaataagcatgatcatccccctgaataaaaaccggagatgatgccagttagctgttacctctgcattttcataaacgttggttttcaagaaccaataaatcgtgtggctggtgcgctataaaaatcgcagagcggtgacgatagtccgcataaggagctgttcgttcgcaacattcgaacggtgacgttaaagccggtttcattggctaatgaagacgaaggggacaaaattactacagagttgataccacagagatagtccaggttcgcaggtgatacgggatttaacgccggaaagtctgcacagacacgatctgccgccggacaccattaaattgccccgcaacgtgttatcaatactactccctgcgtttcccgttaccttgctgtcggtacgtttaccgcattgtctgaaaggttatttgcgaagttatcattaataatccacgggcgtctggtatgcgaatccagttccccaatcctggcgttttgccttctcgaccatacgcgcgtaaataagcctgaaaccaaacttcaccgcttaacgctctcctcttccccgatttttacgcaaaaaatcatcacatgatcaagggtcgtatttattattgcatttttcaaatgatattggtaattattatcattctcattaacgacttattcgatttatgacgtggagagagaggatttctcatgcgtattctgtttgtcggtccaccactgtatggactgctataccctgtgctgtccctggcgcaagcgtttcgtgttaatggccatgaagtgctgattgcaagcggtggaaaatttgcacagaaagcagcagaagctgggttggtggtatttgacgctgcgcctggtttcgattcggaagcgggttatcgccgtcaggaggcattgcgaaaagaaaataacattggaacaaaaatggggaacttctcatttttcagcgaagagatgaccgacccgctggtcgcgttcgccggacagtggcggccagatctcatcgtctatcctccccttggggtcgttggaccactgattgccgctaagtatgacattccggtagtaatgcaaaccgtcggcttcggtcatacgccctggcacatcaaaggcgtgacgaaatcactttctaacgcctaccgccgccatggggtcagcgcgccaccaagagatctggcgtggatagacgtcacaccgcccagcatgagcatactgcaaaatgacggagagccggttatctccatgcaatacgtcccgtataacggcggcgccgtctgggaagaatggtgggaacgtacacctgatcgcaagcgtcttctggttagcctcggcaccgtcaaaccgatggtggatggcctggatctgatttcctgggtaatggattctgccagcgaagtagatgccgaaatcattctgcatcttccggcaaacgcccgctcggatttacgttctctgccgccgaatgtccgtctggtcgactggcttccgatgggcattttccttaacggcgccgacggttttatccaccatggcggcgcaggcaacactctgacggcgctgcatgccggcattccgcagatagtctttggccagggtgccgacagacctgtcaatgcccgcgccgtggtcgagcgcggatgcggcattattcccggtaagagcggacttacgagcagcatgatcaatacctttctcggtaatcgcgcgcttcgcgagacgtcgcaggaagtcgcggcggaaatggcggcccagccttgcccgaccgaggtggcaaaaaaactgatcgccatgctgcaacacggctaaccgcggcagcgcaatgacaatatggcggctgagcccagactgtgtcgccataactcatctttcaccgataaggaggcttaatgcccgcgactcattcccccatgcccgctcgtgcctggatagttcgccttgcccgcgtgtgttgggaacgtaaaacactgagcatcattgtcatcgtagcatcagtatcgaccattttactggctgcgctgacgccgctaataacgcgtcaggccgtcaatgacgcgatagcaggcgatacgacccgcctgccgttacttgcctgcggcctgctgttaattgccctttttgattttatcgggaattacgtgcgccgcggctatgccggagaactctcgttgtgggttcagcatacgttacgtagccgtgcgttcgacagtattcaaaaactggacggcgcaggccaggacgccttgcgtaccgggcaggtcatttcgcgtaccaacagcgatcttcaacaggtacacaccttgctacagatgtgtccggtgccgctggcggtgctcacttactatgtggccggtatcgcggtgatgctatggatgtcgccatccatgacgcttatcgtgatttgcgtactggccgcccttgctattaccgccctgcgcgcccgtcgccgtgttttcgcgcaaacggggcttgcctcagaccggctggcgcacatgacggaacatatgcgcgaagtattggaacagatctcagtggtgaagtcctgcgtggcggagttacgcgaaacgcgttggctcgatggtcagtcgcggcagatggtgcgggtacggatcggtgccgctatctcgcaggcgatgccgggcgcaaccatgctggcgctaccggtgatagggcagatcgtcctgctgtgctatggcggctggtcggtgatgaacgggcgcatcgatctgggaaccttcgtagcgttcgcgagttttctcgctatgttgaccggccctacccgcgtactggcatcgtttttggttatcgcacagcgcacacaggcgtcggtagagcgcgtcttcgcgcttatcgacacgcgttctcgcatggaagacggtactgagtcggttgagggtcagattatcgggctggacgtggagaagatgagtttccactacgacaacggtaaccgtatcctcaatgagatctcgttttccattcacgccggtgaaaccgtggcggtggttggcgcatccggctccgggaaatcaacattgctgatgttgctggcgcgcttttacgatcccacctccggcggagtatggctcaacaccactacgggtcaacagaatattcgcgacctgaaactgacggcgcttcgtcgtcgcgttggcgtagtttttgaagacgcgtttctgtttgccggtacggtggcggaaaacatcgcctatgggcacccgcaagcgactcaggacgacattcgacgcgccgccgatgccgcaggcgccagcgggttcatcaatgcgctaccgcaggggttcaacacccgactgaccgaacgcggaagcaacctctccggcggccaacgccagcgtattgcgctagcccgggcactgattaccgcgccggaactgctgattctcgatgacaccacctcggcggtcgatgccggtactgaagcggaaattaacacggctcttggtcgttatgccgataatgagcatatgctgctggtgattgcacgccgccgttcaacactgcagttagccgatcggatcgtcgtgctggataaaggccgcgtcgtggatatcggtacccaggcggagctggatgcaaggtgtccgacgtttcgctcgctgatgagcggcgagggggattttctcgcccttgccccggcagaacaacgtacgctatggccaacaacgcaggcggtaaaatccgacgacgcgcatgagcgccagacaaccgccggaaaaggttttgtcgaccggatgacgcgcgttccggaacgcgccgtacagatggcgctggcaggccacgggagtcaagtctcatcgctgctgacgccagtagcctggatgttcgtcatcgccgccctgcttatcgcgcttgattccgccgcaggcgttggcgtgctggtgcttttgcagcgcggtattgactcaggcgttgccgcaggggatatgtcgactattggcatatgcgccctgctcgcgctgtgcctggtggcgatcggttggtgctgctatgcgctgcaaacgatcttcgccgcccgcgcggcagagtcggtacagcatacggtacgcttacgcagcttcagccacctgctacgcctgagtcttccctggcacgagaagcacatcgactcgcgtcttactcgcatgaccgtcgacgttgattcactcgcccgatttctgcaaaacggtcttgccagcgcggccaccagcatcgtgacgatggtcgctatcgccgcggcaatgttctggcttgaccccattcttgcgttaacggcattaagcgccgtacctgtagtgatactggcgacgtggatttaccgccgtttgagctcgcctgcttacgcccaggcacggctggaaattggtaaggtgaacagtacgcttcaggaaaaggtctccggtatgcgggtagtgcagtcacacggtcaacagaagcaggaagccgccaggctacgggcgttatcagacaacttccgcgccacccgcgtgcgggcgcaaaaataccttgctgtctattttccgttcctgaccttctgcaccgaggctgcctatgccgccgtgcttttaatcggagcgacccgggtcgccgaaggcgaaatgacgcccgggatactggcggcgttcttcctgctattgggacaattttatggcccggtacagcagttgtcaggcattgttgattcctggcagcaggcgaccgccagcggcaaacatatcaatgcgctattggcgactgaggaaacggagaatattgaaccgtcctccataacgcctggcactggcggcgcgctacgtctggaggcattgacattccgctatcccgaaaaaacgcaacctgtgcttgataatctctcgctcaccattccgccaggaacggtagtcgcggtggtcggacgtagcggcgccggcaaatcgacgctgatcaagctgctggccgggctctactctcccggcagcgggcaaatccgtgtcggtgagcgcctaattgatgccgcgtcgcttagtgattatcgtcgccagacggggctggtcacccaggatgtcgcattatttagcggcgatattgccgaaaatatccgctattcgcggccagacagcagcgacacggaggtggagatcgcggcgcgacaggcgggactctttgaaactgtgcaacatctgccgctggggtttcgtactccggtcaataacggcggcacggatctgtccgcgggccagcgtcagttgattgccctcgcgcgcgcccaactggcacaggcgcacattctgctgctcgacgaggcgacagcacgtatcgaccgcagcgccgaggagcgcttaataacctcgcttaccggagtgacgcataccgagaaacgcatcgcgcttatcgtcgcgcaccgactgaccaccgctcgccgctgcgatgttattgtcgtaatcgataaaggatgtatcgctgaatatggcagccatgagcagttgatagcggctcatggcctgtatgctcgtctgtggcgggccagcgtcggccagacacgcgatacgcaaggagaggtcgtaggatagtttttatcgccacgatttacgcaaaagaaagcccgcaagcggctgttcctgtaacagccgctttagctattgatactgaccgaaatataaacgagatggaatacaaagaatgagactgagcccgcccgtcgctcctgtcgctatacagaccgctacgcgccttcgccgtcaactcgccgccggaagccaggttgacgcttctcacttctggcgagaagcaaactcgctcgcgctgccgctggtgacagccattaacggcgcagacgatgaacgggaagtcaccttcctgtggcgtgccgcctctcctctgcggggggtttatgttcgcctgaaccgtgtcaccgataaagataacgtggcgaaaggtatgatgacgcaactgcccacaacggatatctggcatctgacgcttcgcttaccggcgtcctactgcggttcctatacgatggtcgaaataccaccgaaaaccccggacgagacggtgttgcagcttggaagccgtttcgcctcccttgtcgggaaggcggacccactgaacagcacgccgggaataaatgttcggggcaatgcgcaggagtccgttctggcgttggatcatgccccggcacaggaggagtggtcaggctgtcgcgcttacgccgggcagcttttcacctcagaacatcggctcgccggacaacgtcgccgtgtgcggctgtatcttcctgacgttcctgtcgaacaaccgctgggcttgctggtactcacggatggcgagatctggttcgaccatcttggggtaagcgccgccattgacgccgccatccgcagcggacgcatcgcgccggtggccgtactcggcgttgataatatcaatgcgcgtgaacgcgtcgcaatcctcggcggtcgccgcgagctggtgctcgacattgccgaacgcctgctgccaacccttcgcgccaaatacccggaacgacagtgggcggaccgtacacaaacggtgctggcagggcaaagcctcggcggcgtgaccgcgctgatggcggcccgccacgcgccagagagcttcggcctggtgctgagccactccccctcaatgtggtggacgccggacaaccgcaatcgcccgccccatttcagcgcagaagagcgctcatgggtcagcgaacatgtgttatccgcgccctcgccagccgtacgtacgcatctgtgcgtgggatcgctggaaggttcgacggtcccgcaggtcaaacagttgcatgaaaaattgcgcgccgccggtgttgaaagccattgctgcgtgtacaccggcggtcacgattatgcctggtggcgcggcgcgctgattgacggattacgtctactgccccgataaaacttcacctgccaaaaaggaataacatccgatgtatggtcgccagtaccacaacaagtgctatcgcgtggcgctatttttagtgagtttttgttttagcgcgctgagttatgcgcagccggatatgcagccattagggccgaatatggctgataaaggttcgggatattaccattttagggtcaatgactttcaatctgccgatggcgcaagacattaccgggtatggaccgctattcccaataaagccgccccgccgtcgggttatcctgtcttatatatgctggacggcaacgcagtgatggacaggctgccggagacgctgctcaaacaactggcagaccactcgccgccggtgattgtggcgattggctatcagactaacctgccgtttgatcttaacggcagagcttatgactatacgccggcgccgggaatcgatcgcgatgacagtgaaaataacccgcgttttcatcgtaagaccggcggcgggccagcgttccgccagctactggagagacatatcgcgccgcaggtggaacaaggaataaccatcaaccccgaacggcgcgggatatggggacattcttatggcggcctgttcgttttggactcctggctgtcgtcatccttctttcatatctattacagcgccagcccgtcactcagcagggataactttgccctgttgaatcgccttacggcagtgaagccgtcgccgttctgccataaaaaactcatcataatggaaggttcagcgtcgaatggggatagcaggcaacgccagatggccgagctcctgcaaaaagttcaggagaccgtgagaacgcttgagaacaacggcgttaacgcggccctgcagcattacccgggcctgggccacgggcccatgtttaacgcctcttttcgtagtgcattgctgggtatcagtcgcgaaccggcaagctaagaaccacgctgccattaacccgtcgccagaatatgcccgccagcggcgggcataacccatcaaaacgaggccgtcacaccggcataataagcccgacccggttcgttataggtatttgccccttcggcggagcgatagatctgtttatcgaagatattgctgataccgacattaagacgcaggttcttattgatatcgtagttaacgttagcgccgaccagtgagtaagcccccagcgctttcccggacaatcctttggtctcttcactacgcgactccgcatgtgttcgcggtttttgcttgccgtataacgtccagttgacgttagcggagagcgcgttggtgatagtccagtcgaggaaggtattcaccgtatatttcgggattatcgataagggattaccggtatctttttgctcagaagtgatcatataagtcgcattggtattccagttcagacggtccggcatcagcggaacagccatgctggcttcaataccttcaatcagcgctttaccgccgttctgccactgcaatacataagcgccagatgcgcttctgccaataatctgatcacctgcgacaatcttattctgataatcgttacggaaatacgttacgcttgcgtgataatcgtctacggtaaattccagcccaatctctttattgatactaatttcaggatcgaggttcttattaccaaccaggtaacagccgcccgacgtaatatcttttggacaaccgttgcctttcgaatagagtaaatacccctcactggtttgatacaagttcggtgccttaaaggcccgggcaataccggctttcaccttgacgaattcacctaactcctgggaaaggttaagactgggactaaaattactcccggattcgctcaaatagtcaaaacgcagacccggaataatattggtaccggccatgggttcgatattatcttcaacgtacagcgcactgatttccgatttatttttactgctacggttagccgccgaaccgggaatcccggcgatattgctatccttaaccgtcagactggtagaggaaggatcgttcagctcatcgcggttccactccgcgccgacggtgagcgtttgctcaaatagccatatcaccgggacattcacctcgccgctggtgcgatacgaggtcaggcggttagtggtgaacgtctggtcgttggtaatacgcccctcgccgccgccggagagtccctcattcatgcgggtattatcggttttttcatagtagaaccccaggcggctttgcccccagccccagatgccgttatgagttagaccgtaattctgccggtacaggcgattggtctcccgcccggactgcgccagacttttggtaaccgcgtttgaattactgttttgcgtatcgccggcatagatattcccctgccgactgtatcccgcttcaaaatcaaggatttgctgcggggtcattttccatgagaagacgctattaatatctttattggtgaccccctcccgtccggcggcatttttggtaccggcggaggagttaatatcccagctgtcggcatcggttctgttgagattaccgtacaggcgcatcgtcaacgtatcaccagccaacgggccgctaaggctaaagttaccccgccgggtgtcaccttctttgctgctttccgggtagttggtataaagcgacagcgagccatgccagtcgttagtggggcgtttggtgatgatgttcaccaccccgcctgcggcaccggagccatagcgcgcggcggcgggcccacggatcatttcaatacgttctaccatctccggcggcacccagttcgtatcgccacgggtgtcgcgttctccgcgccagctatagcgaaccgaatttcgcgacgtcaccggcacgccgtcaatcagcactaaggtattttccggccccataccacgaatatcaatttgtcggttatttccgcgcgtccccgaggcgctattgctggtaagattaaccccaggcatcttacgaataatatcggcaagatcgttaacgggaggattcttctgaatatcgtcacgagtaataatcgaaacgcccggctgttgctttaatacttgctcggcagtggattcaaccactatcgtttcgccgttgtcgtctgtagattctgctgctgataatggactattaatccctgtagaaaccacggttattaaccagatgaacttcttaactctcatacccattccctaaataatgtctaaagtagcgctgttgccctcaagctcacatccttgccaggttacggctatatagtaattattatcatatgctaatgataataattatcattcaattaagaaaaaggcaatctttcgaccgcaaaatctggtcataagaaaacagaaacgggattttgcaatatgactctctgtccgggctccgctttgccaataaatccgggaagggtggcagaatgcgcctactgagcggaggttttacaaaacaggaatagataaaataaaactatttttcaaagcgttaatgataataaacacccaggtaagatggtatagtgcggttcagagttcaccggcgcttccctgtcgacggcaaaccgttcttacagtttgccgtcagggtaatggcgggatcggatacgattgtagtcattcgatatatgacaatgaaagtgatgttggcgccaaaatacaaagcgcctggtaataattatcaggcgctttgcagacagaaaaccatcaaacatcggtttctcgttctccaggatctactggaaaatatggcaacccacagttagtggattttactgtcgggtcttgccagggatgttgtgttacccccaggtcttttaaaagacctcgtaacagcactaactcgctgggtgtcattttttgctttggttcaccctctttaggtggacgaatatcctcctgactagtacatgtaacacaataaccttttaactctatccacttaggcttaggggggggccttaggatcgggaggcgtcgggctggcaacgcacgaacaggcacttatacatccaggcataacgttttccttttcaaacaattcgctttagttggaagttctacttgagaaaatagaaatggttattcagatatttttaccggcgcatactcctgtaataataaaagatactgtaaataattaactctcagctactattcagtagcagattgttattcttacattgcttttatttcagatttacgtcaaatagggctaaatattttcactataaaatacgttaaaaagtgtttgtgtacttgtagacattgtggcgtcttcggtacgcaaatcggttagtgtacaatctttaaaactggtatttcttaaattagcctcagacaaatcagccccgtccaggttcgtagcagtaaaactagccttttgcaggtttgcccgagttaagacagcgccttccataatagcagccattatagtagcaccctttaatgtcgcaccgctcatatcggcacgtataagggttgagcctgaaacattagcgtgatccatattcgcaccggaacaattacattctaccatgctacagcctaacagacttgtgtgttgtaaattggcgccagtaagattagcgcgatcgagggtagcgccacacataatactatcttccagacaggcgttcgttaagttactgtcgcctaatgatgctcccgatagatttgcgcccttaaaatttgcaccgtcacaatccgccataaacagtattgccccctctaaatctgcgccgcttaagtctgcgtcacataaattttctgccgtcagatttgctccggtaaggacagcgcctttaagattcatgcctccctgggcagttaatattacagaatcctgaggaagagaaaattcgcatctgaatagtaaagctcgacatattttttcaaaagaggcaagcggaatttctcttgtctcagaattgtcgcctttactgactcgtacaataacttgtccagcttcgttattctcaccaggaagattaaattcgacacgacacccatccacatcatccaggatgatgttttctggcaacggagcacctctgtcagacattgaacttttcaatgtttcagccatagtctctatcaattcctgatattgtgtttcatttctccgacgtatcccaccacaggtaaaaaagttaatgatatgttgcagaatggttttgggcgaggtagcttgccgcatagcagcagaagtccccgcgccaaaagcagatgtagccataccagccagactatcgagtgaacgctgcatatattttctcccagagagagcaacacagtacatgataaaatttatcattagatttgcatttagaaataaggtgaataccccctttgcgtctggttacataatcacgcatcacgacgcgttgctgtctgacttacacaataccagccaaataaatatattggcttatactcgtcatacttcaagttgcatgtgctgcggctgcgttccctcaccccagtcacttactttagtaagctcctggggattcgctcgcttgccgccttcctgcaactcgaattatttagagtataaacattatttaaaataataaacacggcattcgttttaatactacgttcaggactcatcccactcattagcagaaaatctattaaaaagcgcgttcaggcgttttattgctgccattgataaactgtttaacaacgtcgtctgtacaggccttcttcgttgcctttacgtttaactcaatcaggctaccgtctcggttataagtctatcgagtagtagggacgtagtatgacgatgcagcaaagtgatatggaaagatataatccattattaatgttaaaagaagtcatggcgcagacgccttatcgccataaacgctggggagagcgtaagtttcgctataaatttgtattacgttgccttattaaccccgtaacgacaattaaatacttcaatgaattatgccatctgtctcagcccagaacgctgattattcatcgtccactgttgccggcaaaaatccagcggccctatttgtataccggacttagcatacgttgccgggcaaaggctattctggaacactaccagttcgttcagtcctttccggaaagtaaaattaaaaagatccttctgtccgaggaacaaatcttactcgctcacctggaaggaaaaaacggtgctctggtagatatctactgcggtccctgtggctatgacagagaaggtgaactgacattaacgctgtgcttcaatgatacgccgttggcacgtttatcattttcctttatccgccatgaagggaagcaaatagcgctggttgccgggttacaggggcccagtaaacatatcggcccacaagtcatacgtaacgccaccaaagattgttacggtctctttcctaaacggatgctgtatgaagcatttgcgacattgatgcaggcctgtaatgtcgacgagatttacgcggtaagtgaaaacaaccatgtttatcgtcaactcaggtacttattccagaagaaaaaaacttttgtggccagctatagtgaattctgggagtcgctaaacggcgttaagaaaggtgccttatatcatctgccatcacaggtgatgcgtaaagcgcctgaaagtatccccagcaaaaaacgcgcagagtatcggaagcgctatcatattctggatacaataatacaagaggttaacagcctctcccggtagaactatttcatacgcggatgtgcagatcctgctaccgttcagcggatctctttgaaatctgtatcgctactggatggttaaatacagaatggcttgcgagtgaaaagcgcggcattaaaccgtcgctttcattcatgctatgatcaacatcttaatcttattcccttcaccataacgtcatcgattagcatgttaaccattaaatacaagctaaacatttgtcacatttttatttggttgagcaaaaaaataatacaaaatagaattttcagtaagctaagtcaggagttttagtgaaaatacaagaagttaagcgtatattaacccgctggcagccgtcttcctttaccctataccgggaggtgtttacgcaatacggcggtagtatcaatatgcacccagatattgtggattattttatgaagcgccataactggcattttaaattcttccactataaagaagatgataagattaaaggcgcctactttatctgtaatgatcagaatattggcatcctgacgcgcagaaccttcccgctatcttcagatgagatacttattccgatggcgccagatttacgctgcttcttgcccgatcgtactaaccgactttcggcgttgcatcagccacaaatacgcaatgccatatggaaactcgccagaaagaaacaaaattgtctggtcaaagaaacgttctcttctaagtttgaaaaaacacgccgtaatgaatatcagcggtttcttaaaaaaggcggaagtgtaaaaagcgttgctgattgttcttctgatgaactgactcatatttttatcgagttatttcggtctcgtttcggcaatacttcatcctgctatcccgctgataaccttgccaacttttttagtcaactgcatcaccttctgtttgggcatattctttatattgaagggataccctgtgcatttgatatcgtactgaaatctgaaagccagatgaacgtctactttgacgtatctaatggtgcaattaaaaatgaatgcaggccactcagtcccggcagcatactaatgtggctaaatattagccgtgccagacattactgccaggaaagacaaaaaaaattgcttttctccatcggcatactaaagcctgaatgggaatataagcgcatgtggtcgaccccctattttaccgggaaatcgatttgctaaaaagaaagcctggacgtaaatatgttttttacgcccaggtttttcataaaccctgataaaatgataaaaaacgaaaatttaatcagaatttaaaaaataagttaaccaccatataatcataatgacaattactcgaaattcacttacactatgctcggttttatggaattgattaacacggtatgttacagataacgtgctaaaaagcgtgcagcggttatacattttcatatgtgtgtgtcattaacctggcgtcaggaacagatgatgatgacaactaccattttatctcttctggcctggcataccgtcagtagattaaaggtgtagccttgctttatggcattacaaaaatgtgggtgaggtctatgctcaatgtatacgttatttgtaacaacgctcttgtgcataaacaatacgttattgccaacagcactgaacgggtacagtggttcttgctgacaacaggcttaaagatcgtcttaacacgggatacctgataactggattatattatgacacatgcagactggctgattcttgggtatacaactgttattattatttttggtattgtatgttatatcggattgcttaaattgataacgaaaggcaagcatgaaaaataacgcacttaccgggaagaatatactctcaggagataaaatgcttcggcaatgatatgacaccactgccgaaatgctatttttacagaaatcaatcaggtattgagggtgattttatcatagccgcgccagcgataattcaacaacgagagcagccagaatagcacaaaagcacccactacccagaagcccacattccccatatgatcgttaagcgtgctgacggtctgccaaaatgttccgcttaactgtaacgcatcatcaatcaaccccagcgcttcaagcccgccaatcgccagcgcgacaatgacggatgcggcggtaatggttatattataataaagcttacgtaatggatgcgagaaagcccaaccgtaagcgccgaccatgacaaagttatccagggaatctaccagcgccatcccggcggtaaacagcacaggaaaaatcatcattgaccagagagatagcccctggttagctgctgaagcggaaatgcccagcaacccaacctcggttgcggtatcaaatcccaagccaaacagaaaaccgacaaaatacatatgccaactggaagtgaccaaacgaaacgtacgctgaaatatacgcgtcatcagcccgccaggtatcgcctcgtcatgcgcccccactgactcgccgcgggtaaccgagcgaaattgccgccagacgttgaacaaaataaacaggttgagcagggccatcgccagcagaaaaaaagcggaaacagccgtaccaatcaacgaaccatattgatgcaaaacatcaatacgatcgcgaaatgccatcgacgtcacaacaatcgccagacatgccagaacgacaatggtcgaatgacccaatgaaaaaaacgcccccacgcctaaaggcgttttaccctgctgcatcagtttacgggtgacggtatcgatggctgcgatatgatcggcatcaaccgcatgacgcagcccaaagctatacgccagtatggctgcgcttagcatgactgcatggtgatgaaaaacacagaacgcccaaatctaggccaggatgttaaccccgacaagaaagacggttaatgctattccccgtcgtttagtatgattattcatgcccctgcacccactatagttttaattaacgctacggtttgtagggggaatgtatgatcatttgattaaaacgtcacacctcaagatgcgactttttgtaaacgtgctttaccgctgacacatttgtgcgcattactgcgggacaaggcttaaaaagcgtatccgaacgtataaccctcccaacgcttcgctacgggaaaaatggggatgagtacggtgcaagcgtgcgatatcattgaccaaagccagaccaatgcccgccccggccacatttcctacgttatcgagccggtggaacggctgtagcgccagatggatgtgttcattatcaatgccggggccgctatcttcgacaaccagcgtcacggcatcgccatcccgttcaagccgcgcggtgacaatgccttgctcaggcgtgtatttcagcgcattatccagcaagtttccgcacagctcgctaagcagtacctcatccccctcgatccacatcgcttcctgttcgccttcgtagcccaggtcgatatgtttactgcgcgcctgcgccaggcgggtaaagcagccgctctgtacgatatcgtacagattcaccggggaaaaacgcctctcgccctgctctttatgctttaccgcagaaagttgcaacaatctttccgtgagctgaatggtgctatccagcgttacgctcatcgcctgcagactttcgtaccagtgatgagggtgctggctggctaacgccaccgccgcctgcgtttttaacaccgccagcggcgtttttaactggtgagaagcatcggcgctaaagcgttcctgccgggaaaggatgccgcggagcctgtcaatgtagcgattaaacgccacgattaacaagcgtgtttccgaccacggcagcagttccggcagcggcgttaacagacccggttcgcggcgtaccattaatgacgaaagttgacgcatagggcgcaggatccggcgtaataaccagccaaccagcaccagggtcagcaacaccagcagcccctgtgagatccaggaagagaacagcagttggcccgccagataacgacgggactgcagcgtttctgcgacataaacctccgccatgccgataatgccgccttcgttgaccggctgtagcaaacgcgctacgcggatcgcctcgccgcgatactcggtatgatagaaccacgccagcgccggataaagccgggtacggggcgtagcgggcggcatggcaggcagatcgtcataaccggaaatgaccttcccggaagggtcgacgactttgtaatagagtcgatcattcatattaagctcgaagctatccagcaccacccagggcacgttaacttccagatggttattgcgcaccaccagccgttccgataccgttcgcgccgaggagagcaacgtacgatcataagcctgagtggcggcctgtagcgcattgacataactgttaaacgccgacagcccccatagcagaatcagcggcaaccccaggaacagtaagagttgcaggtacaacgattgcggcttaacccacttcatcgccgcgctccagcacataacccaggccgcgcagcgtcgtaattcgtacatcgcttccctgaagttttttacgcagtcgatgaatataaagttcgatgctttcagggcttacctcatcgttcaggctgaacacctgttcaaaaagctgctgacgcgagacaggccgcgttcgtcggtacatcaatacggttaagagcgcctgctcacgcggcgtcagcgctaacggctgtccctgtaacagaaaatacccttcatcatgaaagatcaattcacccagttgctgaacttcatgaaccagcccagcgctgcgtcggagcaaggcccgtaaacgggcatccagctcttccagttcaaagggtttcggcagatagtcatccgcgccgacgttgagaccttttacgcgatccgccaccgcgcttcgcgccgtgagcagcaaaacgggcaaggtctgaccgcgtttacgcagccgttgcaccacctccagtccatccattcccggcatattgatatccagcaccatcagcgcatacatttcactgtgcagaagatggtcagccgccaggccgtcaaatacgcagtccacggcaaagccgttttgcaccagcgctttctccagccagtgagccagctcacggttatcttccgccaataagagacgcatatcacatcctgtaaagtttctgccgcattgaaagggaattgaaaggttattgttttaacaatcacgcaaccgaactgctacatgtcggctcacataatcacaaaaatcttcttccgaacctgaaaaatccggacgtccggcgtgaggataaaaaatgaaaaaacaattacttcgtacccttactgcaagcattttattaatgagtacctctgttctggcacaggaggcgccgtcgcgaacggaatgtatcgcgccagccaaacctggcggcggttcgctgctcaacctgtcgcaggggaaatttggtcgctacggcgtggatgatgtgcgctggctggcaagcgtgggcactgattacggcatgatcgccgtgcgtgcggattccccgtggaagacgctgaaagatctgatgacggcgatggaaaaagatcccaacagcgtggtcatcggcgctggcgcctctattggcagccaggactggatgaagtcggcgttgctggcgcaaaaggcgaacgtcgatccgcacaagatgcgctacgttgcctttgagggcggcggcgagccggtgacggcattaatgggcaaccatgttcaggttgtctccggcgatctcagtgaaatggtgccttatctgggcggcgacaaaatccgcgtccttgccgtcttttcagaaaatcgtctgctgggccagcttgccaatgtccctaccgctaaagaacagggctacgacctagtgtggccgattattcgcggcttctatgtcgggcccaaagtcagcgatgccgattaccagtggtgggtggataccttcaagaagctccagcaaaccgacgagtttaaaaagcagcgcgatctgcgcggcctgtttgagttcgacatgaccggccagcagctcgatgactacgtgaaaaaacaggttactgattaccgtgaacaggcgaaagccttcggactcgcgaaataatcgcggaggcaatgatgagcgatcgtatctttgcgggtatctggctgttgctctgtatcgccgggctattcatcgcctggcagatccaaagcgaatacagctatgaacccgtcggcccccgcccttttccgctggggattatcggcctgatggcgctctgcgcgctggcgctgttattgcgccatcccgacacggtgagctggccgcgccgccatgttctgcaaaagctaattaccatgatcatcatcctgttgatgtatgcctggggattcgaatggctgggttttcccatcgccaccgcgcttctcaccatggttatcgggatgctgttcggcgccacgattccggcggcgggtatctccggcgcggtattaggcattctgctgtggtatgcctttgaccggctgcttgatgtcaccttacctctcggcgcctggctgagttaacggagcaacgatggatacctggatatgtctttctcagggctttgcggtggcaatgacgccggaaaacctggttatcgcgttgattggctgcttcgtgggcacgatcgtcggtctgctgccgggcctgggaccgatcaacggcgtggcaatcttactgccgctggcctttgcgttgcatctgcctgcggagtcggcgctaattctgctggcgacggtgtacattggctgtgagtatggcggcaggatctcctccatattgctcaacgtccccggcgatgcggcggcgatcatgacggcgctggacggttacccaatggcgcagcaagggaaaggcggcgtagcgctgtcgatttccgcagtcagctcatttttcggttcattaatcgctatcggcggcatcattctgttcgcccctttactggcgcaatggtcgctggccttcggtccggcggaatatttcgccttaatggtttttgctatcgcctgtcttggcagcatgatggcgcaaaacccgcttaaatcatttctggcagctctgatcggtcttggccttgcgaccgtcggcgtggacgccaacaccggggtttatcgctttacctttgacagcgttcatctttccgacggcgtacagtttatcgtcgtggtgatcggcctgttctcggtatcagaaatacttttaatgctggaacataccagcagcgggcaaacaatggtccgcaaaacgggtcgaatgttgttcaacctgaaagaaggcgcgcagtgtatcggcaccaccctgcgttcttcggtaatcggcttttttgtcggcgtattgcccggcgccggggcgaccattgccagcgccattacctatatgaccgagaaaaaactcagcggcaacagcgatagcttcggcaaaggggatattcgcggcgtcgcggcgccggaggcggcaaacaacgcctctgcctgcggctccttcatcccgatgctgacgctgggcgttcccggttccggcactacggcagtgatgatgggggcgctgacgctgtataacatcacgccaggcccggcgatgttcaccgaacagccggatatcgtctggggactcatcgctgcgctgctgattgcgaacgtgatgctgctgatcatgaatatcccgttgatcggtctgttcacccgtatgctcaccattccgctgtggttcctggtacccgccatcgctgccgtatcggcggtaggggtatatgcggtacacagccccaccttcgatctggtgctgatggtcgcgcttggcgtgttagggtacattttacgtaaaatgcacttccccatgtcgccgctgatcctgggatgcgtactgggggaaatgctggagcagaacctgcgtcgcgcactctccatcagtaacggcaatatggcgattttgtggcaaagcggcgttgccaaagccctgctgatcatggcgatcatagtcattgtcgtaccgccagtgttacgtctgatccgtaaacacagccgtaaaccgcaggttgacgccagttaattgactgctgaaatacgttgtacttgtccggcctacgcgctcatgtgccaggccgggcaaccccgccagcatcactctttccataactcgctcattttacaccccttcttgccgttgtcaggctcgtggcgccgttaacctcacctttcgcattgttaaatatttgttgtttttgatcacaataattaaacaaaagcggttatttcatacgcgttcctggaaaatgtcgatatttttaatttatggctacgaaatgagcatcgccatgtctccctgaccatctaccgagaggaatgattctgatgaatgcactgactgccgtaaaagcgaacacagatgatttagcccaacgccatactggtttcatccttgccccttcggcgcagtcgccgcgcctgctggcgttaacgtttacggcggataccacaagacaatttctccatcaggttgcgcagtggccggtgcaggcgctggaatacaaatctttcttacgtttcaaaatcggcaagatcctcgacgatctgtgcggcaatcagctacaaccgctgttgatcaaaacgctcctcaaccgtgcacaaggcgcgctgttgatcagcgccgaagggatcgatgatgtcgcacaggcagaagagatggtcaaactggcgacggcggtggcgcatcttattggtcgctccaactacgatgcgatgagcggccagtattacgcgcgtttcgtggtcaaaaacgtcgacaactccgacagttatctgcgccagccccaccgcgtaatggaactgcacaatgacggtacctatgttgaggaggtgaccgactacgtgctgatgatgaaaatcgacgaacaaaatatggaaggcggtaattcgctgctgctgcaccttgatgactgggaacatctggagtcgttttttacccatccgctggcgcgtcgcgtcatgcgctgggcggcgccgccaagcaagaatgttagccatgacgtctggcacccggtgtttgatgtcgaccaacaaggccgcccggtcatgcgttatatcgaccagttcgtccagccaaaagactttgaagaaggcgtctggctcagcgagctttcagacgcgctggaaaccagtcaaaacatcctctccgtgccggtaccggtcggcaaattcctgctgattaacaatctgttctggctacatggacgcgatcgttttacgccgcatcctgacttgcgtcgcgagctgatgcgccagcgcggttacttcgcctacgccgccagccattatcaaactcaccaataagcgccacggcgaaggaattacgcggatgtatgattttgtgattatcggcggcggcattatcggcatgtcgaccgccatgcaacttattgatgtctacccggatgcgcgcatcgcgttgctggaaaaagagtccgcgccagcctgccaccagaccgggcataacagcggcgtgatccatgccggggtgtactacacgcccggcagcctcaaagcgcggttttgtctggcgggcaatcaggcgaccaaaaccttttgcgatcaaaacaacatccgctacgacacctgcggcaaaatgttggtcgccacctcggagctggaaatggcgcggatgcgcgcgctatgggagcggacggcggccaacggcttagagcgcgagtggttaaacgcggcggagctgcgtgaacgcgaacccaatatcattggcctgggcgggatttttgtcccttccagcgggattgtcagctatcgcgatgtcgcgacggccatggcgaaccgctttcaggccaaaggcggcgagatcatctaccatgccgaggtcagcgcgctaacagaacatgccgctggcgttatcattcgcacttcgcaaggccgagaaatcgaaaccgctacgcttatcggctgtgcagggctgatggcggatcggctggtcaaaatgctgggcgtggagcccggttttattatctgccctttccgcggcgagtactttcgtctggccccgcgacacaaccggatcgttaaccatttgatctacccgatccccgatccggcaatgccgtttctcggcgtccaccttacccgcatgatcgacggcagcgtcacggtcgggccgaatgcggtgctggcgcttaaacgcgaaggctaccgtaagcgcgacgtttccttcaccgacaccctggagattttccgctccgccggcattcgccgcgtactgcaaaaccatctgctttccggactgggcgagatgaaaaactcgctgtgcaaaagcggctatttgcggcgagtacaaaagtattgccccagcctgaccgtcaacgatctccagccctggccggcaggcgtgcgggcgcaggcggtttcgccggacggcaaactgattgatgattttctgtttgtcacgacgccgcgttccattcacacctgtaacgcaccctccccggcggcgacatcagcgatacctatcggcgcgcatatcgtcagtaaagttcaggcgctacgcgcaagccagagcaaccccggacgtacgctgcgtgcggcacgcagcgtggacgcattacacgccgcatttacccgttaacccttcagacaggaagcaattatgcaacttaacgactctaccctgttccgccagcaggcctttatcgatggcgactggcgcgacgcgcgcggcggcgatgtcatccccgtgagcaaccccgccaacgggaaaccgcttggcaatgtgcccaaaatgggggcggaagagacgcgcgacgccatcaacgccgccaatcgcgccctgcccgcctggcgcgcgctcaccgccaaagagcgagccaatatcctgcgtcgctggttcaatctgatgatggaacatcaggacgatttggcgcgtctgatgacgctggaacagggcaaaccgctggcggaagcgaaaggcgaaattagctacgccgcctcgtttattgaatggttcgccgaagaggggaagcgtatctatggcgacacgattccaggtcatcagaccgataaacggctgctggtgattaaacagcccatcggcgtcaccgccgcgattaccccgtggaactttccctcggcaatgatcacccgtaaagccggccccgcgctggccgcaggctgcacaatggtactcaaacccgccagccagacgccgttttccgcgctggcgctggcggaactggcccagcgcgccggaattctcgcaggcgtatttaacgtcgttaccggttcggcaggcgatatcggcggcgagctgaccagcaacccgctggtacgcaaactgtcgtttaccggctcgacggagattggccgccagctaatggaacaatgcgccaaagacattaaaaaagtatcgctggagttgggcggcaatgcgccgtttatcgtctttgacgatgccgatctggataaagccgtcgagggcgcgctggcttcgaagtttcgcaacgccgggcagacctgtgtctgcgccaatagattgtatgttcaggacggcgtttacgatcgttttgcggaaaaactcaaccaggcggtaaataagctcgcggtcggcgacggcctgcaagccgacgtcgctatcgggccgctgattgatgaaaaagccgtggctaaagtccaggagcatatcgccgacgcgctggaaaaaggcgcccgcgtaattacgggcggtgaagcgcacaaattaggcggcaacttctttcaaccgaccattctggcggatgttcctgataacgcgaaagtcgccaaagaagagacattcgggccgctcgcgcctctgttccgcttcagcgacgaggcggatgtcatcaggcaggctaacgataccgagttcggcctggcagcctatttttatgcacgcgatttaagccgcgttttccgcgtcggcgaagcgctggaatacggcatcgtcggtattaataccggcattatctccaacgaagtcgcgcctttcggcggtattaaggcctccggattaggccgtgaaggttccaaatacggcatcgaagattatttagaaatcaaatatatgtgcatcggcctttaacaggagagtcgctaatgaataccaataacactttaatgcagcgctgtcataacgccgttcctcgcggcgtgggccagattcacccgattttcgccgagcgggcggaaaattgtcgggtctgggatgtcgaaggccgtgagtatctcgatttcgcgggcggcattgccgtcctgaacaccggtcatttacatccgggcattgtttcagcggtcgaagcgcagttgaagaaattgtcgcatacctgttttcaggtgctggcctatgaaccgtacctggcgctgtgcgaacgcatgaaccagaaggtaccgggcgatttcgccaaaaaaacgttgctggtcacgaccggttcagaagcagttgaaaacgcggtgaaaatcgcccgcgcggcgacaaaacgcagcggcgctatcgcgtttagcggcgcttaccacggtcgtacccactacacgctctctctgaccgggaaagtacacccgtactctgcgggtatgggattgatgccaggccatgtctaccgcgcgctttatccttgcccgctacacaacatcagcgacgacgacgcgatcgccagcattgaacgcatctttaaaaatgatgccgcgccggaagatatcgccgccattattattgagccggtacagggcgaaggcggattttacgccgcctctcccgcgtttatgcagcgactgcgcgcgctatgcgaccaacacggcattatgttgattgccgacgaagtgcaaagcggcgcgggccggaccggtacgctgttcgccatggaacagatgggcgttgcggcagatattaccacgtttgcgaaatcgatcgccggcggctttccgctggcaggcgttaccggccgggcagacgtgatggacgctatcgcgccgggcggtctgggcggcacctatgccggaaacccgattgcctgcgtcgccgcgctggcggtactggacattttcgagcaggaaaatctactgcaaaaggcgaatacgcttggcaaaacgctgcgcgatggcctgatggagatagcggaaacgcaccgtgagattggcgacgtgcgcggactgggcgccatgatcgccattgagttgttcgaaaatggcgaccccggcaaaccgaacgcgactctgaccgccgacattgtggcccgcgcccgcgagaaagggttaattctgctctcctgcggtccttactacaacatcttgcgcatcctcgttccactcactattgaggcctcgcagattcggcaaggcctggagattatcgcccagtgctttgatgaggcgaaacaagcgtaatgtccaataagcagcgtcggatggcgacgtaactgtcttatccggcctacaaaaaccgtttcgattgtaggccgaataagccaggcaccatccggtaaacgagcgcaataacaataaagaggttttaggatggggcaattgtcagaatcacatgcattagggggcgggctgaaatcacgccacgtcaccatgttatcgatcgccggcgtcatcggcgccagcctgtttgtcggttccagcgtggcgattgcggaggccggccctgcggtactgctggcctatctgttcgcaggacttttagtcgtcatgattatgcgaatgctggctgaaatggccgtcgccacaccggataccggttctttttccacctatgcggataaagcgatcggcccctgggccgggtataccatcggctggttatactggtggttttgggtgctggttattccgctggaggccaatattgccgccattattctgaattcatggataccgggtattccggtgtggctattttcattagtgattacgcttgccttaaccggaagcaatttattgagcgtcaaaaattacggtgaattcgaattctggctggcgctatctaaagtaattgccattctggcgtttatcgcgctgggcgcggcggcgattagcggtttttatccgtatgccgaggtaagcggtatttcccggctctgggatcacggcggttttatgcctaacggcttcggtgcggtgttaagcgccatgttgatcaccatgttctcttttatgggcgcggaaatcgtcactattgctgccgcggaatccgatacgccggataaacatatcgtacgcgccaccaattctgttatctggtgaatttccatcttttacctgtgttccatttttgtggtagtggcgctgatcccgtggaatatgccgggtctgaaaagcgtaggttcgtaccgttcggtactggagctgcttcatattccgcacgcaaaattcattatggactgcgtgattttattgtcggtgaccagttgtctgaactccgcattatataccgcctcccggatgctctattcccttagccgccgcggcgatgcgcctgcgataatgggaaaaactaaccgtagcaaaacgccctgggtggcggttctcctctctaccggcgcggcctttttaaccgttatcgtcaattattacgccccggcaaaagtgtttaaatttcttatcgacagttccggcgccatcgcgctgctggtctatctggtgattgcgatttcgcaattgcggatgcgtaaaattctgctggcgcagggcggagaaattaagttgaaaatgtggctttatccgtggctcacctggctggttatcggctttatctgctttgttctggtggtgatgctatttcgaccggcacagcaactagaagtcatttcaacggggctgttagggctgggcataataggtactgtccccattatgtctcgctggaaaaaactgataaggtggcaaaaagcccccctgcaaaacctacgttagttattcccggcgtcagccgggaagcttctcaggagtaaaagatgaccgccctttcccaaccgacggccatagatggctatcgctggcttaaaaatgacattattcgcggcacttatcagccggatgagaaactgcggatgagtttattaaccgcccgctatgcgctcggcgtagggccgctgcgcgaggcgctgtcacaactggtggcggaacggctggtcaccgtggtgaatcaaaaaggctatcgcgtggcatccatgtcagaggcggaactcctcgatatttttgacgcgcgcgccaatatggaagcgatgctggtgcgcctggcgattgaacgcggcgatgatgcgtgggaggcggagatcctggcgcgagcgcatatgctcagtaaactggaagccagcgatgccagtgaacatatgctcgatgaatgggatcagcgccaccaggcgtttcattccgccattgtcgccgggtgcggctcccactatctgctacagatgcgcgaacgcttatttgacctggcggcccgctaccgctttatttggttacgtgaaaccgttctgtccgtcgagatgctggaagataaacatatccagcatcacacgctaaccgaagcgatactggcgcgcgaggcggcacgcgccagcgaattaatgcgtcagcatttgctgacgccgattcccattattcgccaggcgatggcaggaaaaatgtagccaggcacggcctgatagccattattcttcaggaatacgcaacacttgtcccggatatattttttccgggcttttcagcatcggtttatttgcctcgaagattttattatacagattggcgttaccatacacttgctttgaaatagcgctcagggtgtcgcctgattttacggtataaaactgactttcagccgctggcgtcgtggttttaacctgatcgtcaacgctgctaatcccggcgatattccccacggcaaccagaattttttcttttgcctcctgactcagcccatcacccgtcactgtcgcttttccatcagcaatttgcacattcactttgtcagcgtcgggtattcccgttttatttaaatgttcctagacttttttcgcctgatcgtccttatcatgattagcggttaccgcgtcccagagtttttcacctgcatcttttacaaaattgaaaagtcccatattcacctcgcttgtcaaaaatacacacaaagaaaagtgtagcagagggaatgaggttatcctgataagcggcgcttatgcgccgccggtggccggtaattaatgacgcatctgaacccaaaatgcatggataagccccggaatatatccgagtaatgtcagcaggatattaaggataaatgcccaaccgaacccttttcctaaaagtacgccgagcggaggcaaaataatcgtaaatacaattctccagaaacccatatacactccatacaagcaaaattagtcattgtttaaaaagagattttatctctaagcatagtcagtttacctgagcctgccagtcgcgcgccgcgcttttaccctcctttacgctttttacgctggcatcaggttgacgtttattttagaattaactaaatttagaaaacacttaaataactatgacagagcttgaaaaacttcaggccagcgcagaacaggcagcggccctgctcaaagcgatgagccacccaaaaagattactgattttatgtatgctttgcggttcaccaaaaaccagcgcaggcgaactggcgcgcattaccgggctaagcccctccgcgacgtcgcagcatctggcgcggatgcgggaagaagggctgattgatagtcaacgcgatgcccagcgcattcactatttcattaaaaatgaggcggttaatacgcttatcgccacgttaaagaatctctattgtccataaggaggcacgatgtccattgggatagtttccccccgtgaggcgcaagcgctgatagcgcaaggcgcgaaactgattgatgtgcgcgacgccgatgaatatctgcgcgagcatattccacatgcgcaactggcgccgctttcccggcttgaacagggcgatttgcccgccaacctgcgagcggaacagattatttttcactgtcagtcaggtaaacgaaccagcagcaatgcagcaaaactacaggccattgccgcccctgctcaagtcagtttactggaaggcggtatcgacggatggaaagcggcaggattgcccgtcacagaagacaaatcgcaaccgttgccgctgatgcgtcaggtgcaaatcgccgccggcgggttgacgttgcttggggtgattctgggctatacggtccacggcggctttttcctcattagcggttttgtcggggccgggttaatgctggcaggcataaccggcttctgcggaatggcgcgactactggaaaaaatgccctggaatacccgtactcattaagcggtactttcaccgcgcgtcggtaagtgtgtagtagactgaaggcgggtttataccattgttcaacgggaggacgtgatgttcacaccaggcgatatcgtacagccccgaatggggggggccgaaactgaaagtgattgaagtcaacgaggatcatattgtcgcggtacaggtcggtaatgagccgggcgaaaaattgatcctcaaagcggcagatgtcaccccctattgcgaaaagggcgattttggcgtgtgctgatttatcaaaatgagcatggcgcaacgttccctgaatcccggttaatagagacaggaaacgcagcgccatctgttaaaggttatccgtgattagattaagaaatcatccagagatttccccgccgccagcgcctgggcaatcggtttaggcgtacgaccttgtccggtccaggttttttcttcgccattgaaatcagtaaaacgatattttgccggacgcggttggcgctttttagcagaacgcggcattgctgaatccatggcaaataactcttccgggttaataccgtctgctttcatcagctccagaaaggcattaattttctcctgcttctcggcaagctggcgttgctgcaattcttcttcttcgcgtctttctttagtgacaaccctgaatttttcgagcatttcttcaagaacatcaatggagaattcgcgagccatagcgcgcagcgtgcggatattatttaagttctgtaacatcaaattcatatcaataaaaaccttttaacgcagaaaacaaaaactattacaggcggtattgtatgcgattattgattatatttccagatcctaaagttcatacagatatacacagcataactcgattaattatattaatctgttaaccagaagattatattcattaccccctgtgtgtttcaggttattctgcctacggtatatctgtaggtttcccgttcggctgtttatagcgtattgcgtatctcagtaaccgcggtgaccctcacggtggctgaccttatacagaagtgaatatttcagcacaataatagattaatcattcaaaaattatcatcagagctttatgctaaaaatcaccctgtaatagctataattatgctgagaaaagcagagcgcgtgccgttagccgagaatacatcgcatctgacaacatttggaatgtggctgaaaatcgccagaaaaacaatgcattataatgtattgatttaaaagtaattaatgactaacaacaacgaaaatctcgccgcgagcaaaaaaacacacaatcacagagtattttatcgacaaaaagcctataaataaaaatattacgctagttgatagttattatatagggatatactctatgaaaagacaaaagcgctttataatttcactaccaactatcacctcattctgatcgatacgctacaaggagcattaacatgttctctccacagtcacgcttgcgtcatgccgtagcagacacgtttgcgatggttgttcactgttctgttgtgaacatgttgatcgagatattcctctccggaatgagctttgagcagtcgctttcttccaggctggtggcgatacctgtcaacattttgattgcatggccatacggcgtttaccgcgatctgattatgcgcgtcgcgcgtaaggcaagcccggcgggatgggccaaaaacctggcggatgtattggcttatgtcacctttcagtcacccgtttatattatcatcttgctgaccgtcggcgccggctggcatcagatagtggccgccgtgagttcaaacattgttgtttcaatgttaatgggcgcggtttatggctacttcctgaattattgtcgtcgcctgtttaaagtgagcagctatcatcaggctaaggcataagttaacgtcgcgactggctttgccagtcgcgcttttagtcgcttttttcgtcgccaaaaagcccattcagataacgttctaacgctattcgggagctaaagccgtggggaataccgtaatgttcgtgggtctcgccgcctaaatagagcggaaaattttggtagtgatcgcaggttttaatatccgaagccgggtcagccagtgatgagctacggtcttttaatctggggtgaatgatcagcgcggtacgccccatacgcgcctcgcggttaacataaacataattctcgccgcgtcgataaccatacgtcttattcgtcaccacatcgacggtaaaccctgccttttccagtacccgcgccacctcgtcaggtcgtaaatacatgttttatcctcattctcttttactgcgggcttaccttacccgatagcgcgttatcaacgctttcagaaaagtccagaaacgcatgatatcgccgtaacaagcctcagcaggtaaaaatatgaactacactgaaagctacatcgaaatcaatggaggatcatatgcttaacaaaccgaaccgaaacgacgtcgatgatggtgttcaggatattcagaatgatgtcaatcgattagccgacagtctggaagatgtccttaaatcctggggaagcgatgcgaaagacgaagccgaggctgcgcgacgtaaagcacaggcgttgctgaaagagacccgggcgcggatgcagggtcgtactcgcgtaaaacaagccgcctgtgatgcgatggggtgcgcggatacgtttgtgcgtgaaaaaccctggtgtagcgtaggaaccgccgcagcggtggggatttttatcggggcgctgcttagcctgcgtcgctaacgacgtgcgctgccggatggcgacatactttatggggcctgcatcattgccgcaggcccaggtcgcgccattcggcgaaacggttactgtatcgcctgtcgaagctgacatgctacctgtttcgccatgccagcggaagtaatattggtaaacgacagtaaaatgcccccctttcctgacgaaaccactcgccaacgacttagcgcctgtaccgccagtccggcctgattcgcttttgctaccagcgctttatcatcaccttcaacctcaataaccaattgaataccgcctttctgtaatgtcacgacaaatccctgttctgccagcgcctcttcaatccataaccgtcgctgagcataatgttgacgcatctttttcagatgccgccagaaatggccatcacggataaaatcagccagcgtgtgctgccataacaacggtacgctacagggcatcagcgacgcctgctggcggaaatgctcaatctgctttatcggcaccaccagccaggcggtacgtaatgccggaaagagcgacttactgaacgttccggcgtaaatcactcgctgcggggcatccagactcttgagcggcggaagcggtttaccgtgataacgaaattcgctgtcgtagtcatcttcaataatccaggcctgcacattcgccgcccatgccagaagttgccgtcggcgagttaacgacagcgccacccccaacggactttgatgggcgggcgtcaccaatgcaaagcgtccctgcgggcaatcccgcatccccgctgcgacattcagcccatcggcatcgaccggaatcggcgccagcgtaatcccctcctgcgttatcaccgggcgaattaacggaaagccgggatcttccacccacatgctgtctcccggcacagacaatgtacgcaggattagccgcatagaatccgcatatccggaggtaataaatacctgttccggcagacattcaatgctacgcgaaacccgcaggtaatcgactatcgcctagcgcaaaatcgcctcgccgcagacgtcgcctaatgccagatcgaagcgtgtctgcgtgcgcaaccgacgccccattactcgcgcccacttctcgcgtggaaagagatccagcgccggtaaccccatctgaaagggtttcggttccggactttctccggcaaaaacagcgggtatcggcggcgccgtctcaaaccgtagagcgttgctcacaaacgtgcctgcctggccacgtcgctccagccagccctgcgctaccagctcgccataggcattttccaccgtggcgcgagaaacgcccagttcctgcgcccacgtccgactggaaggcaaacgcgttccgggcgcgagttctccttgctcaatggccgtttttaactgacgagcgatgtactgatagcgcggcatatggtctgctttttctgtaaaaatatggctctcttttacagaccattatagtgctacagtgctcgtcatcaacacgaggagaaacataatgacgacgttacgccaaccctattatgaactgagcccggaggtttacagcgctctggtgcaggcgaaaaacgcgctggaaaagagcacgattgaccccactctgatggagctgatttacctgcgtgtttcgcaaataaatggttgtgcatttttcctggagatgcacagtaaagcgctgcgtaaggctggcgtgaatcaagctaaattagatgcgctggcaggatggcgggtaagccaccatttcaacgagcaagagtgcgcggcgttagcctgggcggaatcggtgacgcacattgctgaaacccacgccgaagataatgtttacctgccgctgctcgatcatttcagcgcgcgtgaaatcagcgatctgaccttcgctattggtttaatgaactgctttaaccgtctggcgatcggtatgcgaatgtgacgcattgttgccggatagcgctgatgtcagccaactctgttatgcgtgaacctgcaggccggatcgggcgttcacgccgccatccggcaaaaattagccatgccgcccctaccccgctgcgttcatcagcggcgttaaaatcaatcgaaaattcccatatcttgtatggttgaatcttaattcaactacatctagtatttcgtgtatcaacacacgacaatccgacgcgtttcatcgcgccgttttctcattttaaatggaaatacgaatcatgagcattactatttacactcgcaataactgtgttcagtgccacgccacaaagcgggcgatggaaagccgtggatttgaatttgagatggtgaacgtcgatctggtgccggatgcagcggatacgctccgggcgcaagggtttcgtcaattaccggtggtgatggcgggcgatttgagctggtctggcttccgtccggacatgattaaccgtctgcccccgacgccccacgcggcaaacgcatgagcgcgctcgtctacttctccagcagctctgaaaatacgcaccgttttatgcagcgtctggggctgcccgccacgcgtattccgctcaatgaacgggagcgaattcaggtagacgaaccgtacattctggttgtgccgtcatacggcggcggcgggatggccggtgcggtgccgcgacaggtgatccgctttttaaatgatgaacacaaccgggcgcgcattcgcggcgtcatcgcctccggtaaccgcaatttcggcgatgcctggggatgcgctggcgatgtgatagcacaaaaatgcggcgtcccctggctgtaccgctttgagctcatgggcacacaacgcgacatcgataacgtccgaaaaggagtaaatgaattttggcaacaatcaccccggagcgcgtaatgcaggaaaccatggattaccacgccctgaacgcgatgctgaatctttacgataaagcaggccatattcagttcgacaaggaccagcaggcgatcgacgccttctttgccgcccacgtccgcccgcattccgtgaagtttgccagccagcatgaacgtctggagacgctggttcgggaagggtattacgatgacgccgtcctcgcgcgttacgaccgcgccttcgtcttccgcctgttcgagcacgcccacgccagcggctttcgcttccagacgtttcttggcgcctggaagttctataccagttacacgctgaaaaccttcgacggcaaacgttatctggaacactttgaagatcgggtgacaatggtggcgttgacgctggcgcagggtgacgaaacgctggccacccaactgaccgatgaaatgctttctggtcgctttcagcccgctaccccgacttttttaaattgcggtaaacagcagcgtggggaactggtctcctgcttcctgctccgtatcgaagacaatatggaatcgatcgggcgagcggtgaattcggcgctgcaactctccaaacgcggcggcggcgtcgcatttttactctccaatctgcgcgaggcgggcgcgccgatcaaacgcattgagaatcagtcttccggcgtgatcccggtgatgaaaatgctggaagacgcgttttcgtatgccaaccagcttggcgcgcgccaaggggccggcgcggtttatctccatgcgcaccatccggatattctgcgttttctggataccaaacgggaaaatgccgacgaaaaaatccggatcaaaacgctctctctcggcgtggtgatcccggacatcaccttccggctggcgaaagaaaacgcgcaaatggcgctcttttcgccctatgacatacaacgacgctacggcaaaccgtttggcgatatcgccattagcgaacggtacgatgaattaattgccgatccgcacgtgcgcaaaacctatattaacgcccgtgacttttttcaaacactggcggaaattcagttcgaatccgggtatctctacatcatgtttgaagatacggtaaaccgcgcgaatcctattgctggtcgcattaatatgagcaacctgtgctcggaaattttacaggtcaatagcgcctctcgttacgacgataaccttgactatacccacatcgggcatgacatctcctgcaatctcggctcgctgaatatcgctcacgtcatggattcaccggacattggccgtaccgtagaaaccgctattcgcggcctgacggcggtgtcggacatgagccatatacgcagcgtgccctcaatagccgccggtaatgccgcctctcatgccatcggtctgggccagatgaatctgcatggctatctggcgagggaaggtattgcctacggttcgccggaggcgttggatttcaccaatttctatttttacaccattacctggcatgccgtgcatacttcaatgcggctggcccgcgaacgcggcaaaaccttcgccggatttgcgcagtcgcgctatgccagcggcgactattttacgcagtatttacaggacgactggcaaccgaaaacggcgaaagtcagggcgctatttgcccgcagcggcattacgctgcccacacgcgaaatgtggctaaagctgcgcgacgatgtgatgcgctatggcatctataaccaaaatttgcaggcggtgccgccgaccggttcgatttcttacattaatcatgcgacctccagcattcatccgattgtggccaaaattgagattcgcaaagagggcaaaaccgggcgtgtgtattaccccgcgccgtttatgactaatgaaaacctggacatgtatcaggatgcttacgatatcggtccggaaaaaattattgatacctatgccgaggccacgcgccacgtcgatcaaggactgtcgctcaccctgtttttccccgataccgccacgacccgcgatatcaacaaagcgcagatctatgcctggcgaaaaggtattaagtcactgtattacatccgacttcgccagttggcgctggaaagtactgaaattgaaggctgcgtatcctgcgcgctataaggaaagccatatgaaattatctcgtattagcgccatcaactggaacaagatccaggacgacaaagatctggaggtgtggaaccggctgaccagtaacttctggctgccggaaaaagtgccgttatcgaatgatattccggcctggcagacgctgagcgccgccgaacagcagctcaccattcgcgtgtttacgggtcttacgctgctcgacactatccagaacatcgcaggcgcgccgtcgttaatggcagatgccatcacgccgcatgaagaggccgtactgtcgaacatcagctttatggaagcggtacacgcccgctcttacagttctattttctccacgctgtgccagacgaaagaggttgatgccgcctacgcctggagcgaagaaaacccaccgcttcagcgtaaggcgcagattattttagctcattacgtcagcgatgaaccgctaaagaaaaagattgccagcgtctttttagagtcttttctgttctattccggcttctggttgccgatgtatttctccagccgcggtaagctcacgaacactgccgacctgattcgtttaatcattcgcgatgaagcggttcacggttattatattggctataagcatcagatagcgctacaaaaactatcggcaatcgagcgtgaagagttaaagcttttcgcgctggatttattgatggaactgtacgacaacgaaatctgctacacagaagcgttatatgcggaaaccggctgggttaacgacgtcaaagccttcttgtgctacaacgccaataaagccttaatgaacctgggttatgaggcgttatttccgccggagatggcagacgtgaatcccgcaatccttgccgcgctctcgccgaatgccgacgaaaaccatgatttcttttccggctcaggttcatcttatgtgatggggaaaacggtcgaaaccgaagacgaagactggaatttttaaccttgcgggcatgggaaataacgttacattttccatgcctttatttcaagcaataccgggttaaatcgcgcaaatattacaacatgtcctacactcaatacgagtgacattattcacctggattcctccaattcaggtggatttttgctggttgtctcaaaaaatatctctccctccccattcgcgttcagcccttatatcatgggaaatcacagccgatagcacctcgcaatattcatgccagaagcaaattcagggttgtctcagattctgagtatgttagggtagaaaaaggtaactatttctatcaggtaacatatcgacataagtaaataacaggaatcattctattgcatggcaattaaattagaagtgaagaatctgtataaaatatttggagagcatccgcagcgtgccttcaaatatattgaaaagggactatcgaaagagcaaatactggaaaaaacggggctatcgcttggcgttaaagacgccagtctggccattgaagaaggcgagatatttgtcatcatgggattatccggctcgggtaaatccacaatggtacgccttctcaatcgcctgattgaacccacccgcgggcaggtactgattgacggtgttgatattgccaaaatatcagacgctgagcttcgcgaggtgcgcaggaaaaagattgcgatggtcttccagtcatttgcgctcatgccgcatatgaccgtgctggataatacggcattcggtatggaattagcgggcatcgcggcgcaagagcgtcgcgaaaagcgctggacgccttgcgtcaggtggggcttgagaattacgctcacgcctatccggatgaactttccggtgggatgcgtcagcgtgttgggcttgcccgcgcgctggcaatcaaccctgatatcttattaatggatgaagcgttttccgccctcgatccattaattcgtaccgaaatgcaggatgagctggtgaaattacaggcgaaacatcagcgcaccattgtctttatttcccacgatcttgatgaggctatgcgtattggcgacaggattgccattatgcaaaatggcgaggtcgtacaggttggtacgccggatgagatcctgaataatccggcaaatgattatgtccgcacgttcttccgtggcgtggatattagtcaggtctttagcgccaaagatattgcccgtcgcagtccggtcggcttaattcgtaaaacgccaggttttggtccccgttcggcactgaaattattacaggatgaagaccgtgaatatggttacgtcattgagcgtggcaataaattcgtgggcgtcgtgtccatcgactcattaaaagcggcattaagccaggcgcaagggattgaagcggcgcttatcgacgaccctttagtcgttgatgcgcaaaccccactcagcgagttgctctctcacgtcggccaggcgccctgcgcggtgccggttgtcgatgaagaacaccagtatgttggcattatttcaaaacgtatgttgctacaggctttagatcgcgaggggggtaacaatggctgatcaaacgaatccgtgggataccgcacaggtggccgatacgacgacgcaaacggctgatgcctggggaacaccggcaggcgtagccacggacggcggcagtaccgactggttgaacagcgcgcccgcgccagcccctgaacacttttctcttctggacccgttccataagacgcttatcccgctggatagctgggtcacagagggaatcgactgggtcgtcacccatttccgtcccctttttcaggggattcgtgtgccggtggattacatccttaacggctttcagcaactgctgctgggaatgcccgcccctgtggcgattattctctttgcgctgattgcctggcaggtttccggtgtgggcatggggatcgcggcgctgatatcgctgatcgccatcggcgcgatcggcgcctggtcgcaggcgatgattaccctggcgctggtgctgaccgccctgttgttctgcgtcgtgatcggattaccgatgggaatctggctggcgcgcagcccgcgcgcggccaaaatagttcgtccgctgctggatgcgatgcagaccacgcccgcgtttgtctatctggtgccgattgtcatgttattcggcatcggtaacgtgccgggcgtggtggtgacgattatttttgctctaccgccgattatacgcctgacgatcctgggcattaaccaggtgcctgccgacttaattgaagcgtcgcgctcgttcggcgccagcccgcgccaaatgttgttcaaagtgcaactaccgctggcgatgcccaccattatggcaggcgttaatcagacgctgatgctggctctctcaatggtcgtcatcgcctcgatgattgcggtcggtgggcttggccagatggtactacgcggcattggtcgtcttgatatggggctggcaaccgtcggcggcgtcggcattgtgattctcgccatcattctggaccgtctgacgcaggccgtcgggcgcgactcgcgtagccgcggtaaccgtcgctggtataccaccggtcctgttgggctaatcacccgccctttcgttaagtaactctcctgacgcccggtgacattgcgcttaccgggcttacaactccctaccataattaaaggaacaacgatgcgacatactgtgatatttgcctcagcgtttgccacccttgtcaccgccagcgctttcgctgccgacctgcctggcaaaggcattaccgtccaacctatccaaagcacgatttctgaagagtccttccagacgttactggtcagccgggcgctggaaaagttgggttataccgtaaataagccgagtgaagtcgattacaacgtaggctatacctccatcgcctctggcgatgcgacgtttaccgccgtgaactggcagccgctgcatgatgatatgtatgccgcagcaggcggagacaaaaagttttaccgcgagggcgtcttcgtctccggcgctgcgcagggctatctgatcgataaaaaaaccgccgagcagtacaacatcactaatatcgctcaactaaaagatccgaaaatcgccaaaatcttcgataccaatggcgacggaaaagcggacatgatgggctgctcgccgggctggggctgcgaagccgtaatcaatcaccagaataaagcgtttgatctgcaaaaaaccgttgaggtcagccacggtaactatgcggcgatgatggctgataccattacccgttttaaagaaggcaagccggtgctgtattacacctggaccccgtactgggtgagcgacgtaatgaagccgggtaaagatgtcgtctggctacaggtgccgttctcctccctgccgggcgaacagaaaaatattgatactaaactgccgaacggcgcgaactatgggttcccggtcaatactatgcatattgtcgccaataaggcatgggcggagaaaaatccggcggcggcgaaactgttcgccatcatgaagctgccgctggcggatatcaacgcgcagaacgccatgatgcatgccggtaaatcgtctgaagccgatgttcagggccacgtagacggctggatcaacgcccaccagcagcagtttgacggctgggtgaaagaagcgctggccgcgcagaaataatatcgttttttatgccggataaggcgcagttcatgcgccgctatccggccaacgcaatctctcctcaaagcgcacgattcatcacgtcactgttcccctttattcatcaacatccgctatgattgttttcccaggaaataattatctaaatcacgattaccataatgacgaaacccactcatgggcttagcccggcgctgatcgttttaatgtctgtggccacgggtctggcggtcgccagcaactactatgcccagccgctgcttgataccatcgcgcatcacttttcgctttccgccagctccgcagggtttatcgttaccgccgcgcagttgggctatgccgctggcctgttgtttctggtgccgctcggcgacatgtttgaacgccgaacgctgattgtctccatgacgttgctggcggctggcggaatgctgatcactgccagcagtcagtcgcttagcatgatgatactcggaacggccttaaccggactgttctccgtggtggcgcagattctggttccgctggccgccacgcttgcgacgcccgccacccgcggtaaagtggtcggcaccattatgagcggcctgttgctggggatcctgctggcgcgaacggtcgccggactgctggcaaacctcggcggttggcgcaccgtattttgggtagcgtcggcgctgatggcgctgatggccgtcgcgttgtggcgcggactgccaaagctcaaatccgacacccatcttaactacccgcaactgttgggttctgtattcagcctgtttattcacgataagctgctgcgtacccgcgcgctgctgggctgtctgacctttgctaatttcagcatcctctggacgtcaatggcctttttgctcgccgcgccgccgtttagctattccgaggggatgattggcctgtttggcctggcgggggccgccggcgctttaggcgcgcgtccggctggcggatttgccgataaaggtaaatctcacctcaccaccacgttcggcttactgctgctgttactctcctggctggctatctggcttgggcgcacctcggtactggcgctgattattggtattctggtactggacctcaccgttcagggggtacatatcaccaatcagacggtcatctatcgtttgcatccggatgcgcgtaaccggctcaccgccggctatatgaccagctactttatcggtggcgccgcggggtcgctgatttccgcctccgcctggcaacatgccggctgggccggcgtttgtctggcgggtgtcacggtagccttacttaatttactggtctggtggcgaggttttcaccgacaggaagccgtaaattaagcggatagtgagcgtttacctttgtttaagctccttagggtgttaaggagctccccagtctgttaaggttatgctattcatttatcatggttatttttataccggtgaagaataatataattctatggaaagccctgcatccccatctgctcccaggccaatagcgcccgttcaaggattcgaaggtcgttcaccgatagctattcgtgatattccggtggcttttgcatcgggttgtaaggccgtttacccggctttcgcccctcccgcttatcgttctctcctgattttttcatgcaggcactcacgcttttctcgtcattcctggatttgccgcaggcggcgctttaccgggcccaatgttcccgctgacgtctcagtctgcgtatcattggttgctttatagcctgaaagaatgattttgtattaataatacatttactttatttgtcactgtcgttactatatcggctgaaattaatgaggtcatgcccaaatggatagttcgtttacgcccattgaacaaatgctaaaatttcgcgccagccgtcacgaagactttccttaccaggaaattcttttgactcgtctttgtatgcacatgcaaggcaagctcctggaaaaccgcaataaaatgctgaaggctcaagggattaacgagacgttgtttatggcgttgattacgctggagtctcaggaaaaccacagtattcagccgtctgaattaagctgcgcgctgggttcatctcgcaccaatgcgacacgcattgcagatgagctggaaaaacgcggctggattgagcgtcgtgagagcgataacgaccgccgttgcctgcatctgcaattaacggagaaaggccaggcatttttgcaagaagtgcttccgcctcagcatcattgtctgcatcaactctggtcatcacttagcacagccgaaaaagatcaacttgagcacatcactcgtaaactcctgacgcgtcttgatcaaatggagcaggaaggcactgttcttgaggcgctgcgctaaagcgccgacccgctcaaaaatccagattaataacaggaaagcggacaggccggcacgcgttactgctggcctttctgacaacaggtcggctcagccgatgtgaataataagatcgtggagaacaacatgagcgcaaatgcggagatccaacccccgcagcaaccggctaagaagaaaggcaaacgcaaaacagcgctgctacttcttaccttgctctttgttattattgccgtggcatatggaatttattggtttttagtattgcgtcatattgaagagacagatgatgcttacgtggcagggaaccaggttcaaatcatggcgcaggtgtcaggcagcgtgacgaaagtctgggctgataacaccgactttgtaaaagagggcgatgttctggtcacgctcgatcagactgacgccaaacaagcgtttgaaagagccaaaacggcgctggcctccagcgtgcgccagacgcaccagttgatgattaacagtaagcagttgcaggcgaatatcgacgtgcaaaaaaccgccctggcgcaagcgcagagcgaccttaaccgtcgtgtgccgctgggtaatgccaatcttattggccgggaagagctgcaacacgcccgcgatgccgtcgccagcgcgcaggcacagcttgatgtcgccattcaacagtacaatgccaaccaggcaatgatacttaacagtaatctggaagatcagcctgcggttcaacaagcggcgaccgaagtgcgtaacgcctggctggcgctggagcgtactcgcatcgtcagtccaatgaccggttatgtctcccgccgcgccgtccagcctggcgcgcagatcagccccaccacgccgctgatggccgtggtgcctgcaaccgatctgtgggtggacgctaactttaaagagacccaattagcgaatatgcgcattgggcagccagtgacgattattactgacatttatggcgacgacgtaaaatacaccggtaaagtcgtcggtctggatatggggacaggtagcgccttctccctgctgcccgcgcaaaatgcgacgggtaactggattaaagtggttcaacgtctgccggtacgcgtcgaactggacgcccgccagttagaacaacatccgctgcgcattggtttatcgacgctggtcaccgtggataccgctaatcgcgacggtcaggtactggccagccaggtacgaacgacgccggttgccgaaagtaacgcacgcgaaattaatctcgcgccggtcaataaactgatcgacgacatcgtacaggctaacgcgggttaatcctgaggtgcgtgtgatgcaacagcaaaaaccgctggaaggcgcgcagctcatcatcatgacgatcgcgctgtcgctggcgacattcatgcaggtgctggactccaccattgccaacgtggcgattccgaccatcgccgggaacctgggttcttccctaagccaggggacatgggttatcacctctttcggggtggcgaacgctatctcgattcccttaaccggctggctggcgaagcgttttggcgaagtcaaactgttcatgtggtcgacggtcgcctttgccgcggcctcctgggcctgtggcgtatccagcagcctgaacatgctgatcttcttccgcgtggtgcagggcgtggtcgccgggccgctgattccgctctcgcaaagcctgttgctgaataactatccgcctgcaaagcgctccattgcgctggcgctctggtcaatgaccgtcattgtcgcgccgatttgcggcccgattctggggggctacatcagtgataattaccactggggatggattttcttcatcaacgtgccgattggcatcgccgtcgtcctgatgacgttacacacgctgcgcggacgtgaaactcataccgaacggcgacgtattgacgccgtcgggctggcgttactggtgattggcatcagcagcctgcaaattatgctcgaccgcggtaaagagctggactggttctcctcgcaggaaattatcatcctgaccgtggtcgccgtcatcgccatcagtttcctgatcgtctgggaactgaccgacgatcaccctatcgtcgatctttctctttttaaatcgcgtaacttcactattggctgcctgtgcatcagccttgcctatatgctctatttcggcgccattgttctattgccgcagcttttgcaagaggtgtacggctataccgcaacgtgggcaggtctggcgtcggcgccagtcggtattattccggtaattttgtcgccgattatcggacgcttcgcgcataaactggatatgcgcaggctggtcacattcagcttcattatgtacgccgtctgtttttactggcgcgcctggacgttcgaaccgggtatggatttcggcgcttccgcatggccgcagtttattcaaggatttgccgtcgcctgcttctttatgccgctgaccaccattacgctctccgggttaccgcccgaacggctggcggcggcatcaagcctgtcgaacttcacgcgaacgctggcgggctccattggcacctcgattaccaccactatgtggaccgatcgtgagtcgctacaccatgcgcagctcaccgagtcggttacggcgtataatccaaacgctcaggctatgtacgataaactggaaggcttagggatgacgcaccaacaggcgtcaggctggatagcccagcaaatcacgaatcaggggctgattatttccgccaacgaaatcttctggatgtcggcggggatcttcctggtgctgctcggcctggtgtggttcgccaaaccgcccttcggtgcgggcggcggcggcggtggcgcgcactaactatctgataaaagggatctacggatcccttttttagtagaccaacaatcagaagaaatatttgaatctcagacgcccgccgtaacgcgcatcttcactgttatcgccattattcggattggcctctacccatgaagcataggcgccgaggtagatgttaaagtttttcatatccatcacgttggggaataaatatgaggcatgaatagtgtggatgtcataattgccgggatcggtgatccagcaatcgtcctcacaaacggcatcgatattggtagcattaaaggcttcgattttgttatgcgcatagatataacccagttcaaatcgatgccacagcgcattcaccccagcggtaaaatctgtctcatcggtcgcatccatataagcggtattcaggttaataactgcgccatcttccgggtcagttttttgaccattccaggtcatggtaaaaccatagcccgtacgatctgactgatcgatccacttcccattctcataatagccataggcgttgttaacgacgttactttccatcgctatcgccgttgaaaaacgcccgttttgccaggcaataaccggacggacgtaagccacgtttttatcgttggttaaatccattccgtggtactgcttctcggtatataacgtactgccattttccagcaatgtgttaacttcgaaataccagttgtcgatggttttgctcagcaggaagttacccccactgtcgctacgtccccgtccttctttcatcatatagatatagccgtaaccgtcactgtaaagatcgttcgctgtattccccgaatattcaataaatgtatcctgattcagcgggaacatatcgtaggcttcaaaacgaccaaccttaattttccagtcattctcacgaccaaagaagaaaacggcatcatcaaggttcattttcccggtcagatccgccagaggctgtacagagaatccggcaaaattaccgttgtccagccgctggtagccatcaaagcccagcaacaggcgcccgttaatatcccagcgttcattggttcctgatgcccaatctttattcgctgacgttctcatcgaggtcaggctaccggaacggcttgccgcatccatattaaattcgacatcgccatagaacttaatatcgctgaatccggataaggtcagcttcggcggcgttttatctgctgcaatgggctcggcggactggacattcaccgtcggtgtagcggcgacctgctgctgtttcagcgagcgaatttgcgcctcggcatcggatgcccgtttttcagcattaacaacacgttgctccagttcagccagacgctgctcaatagtgatatcattcgctgcccaaaggttatgagaaaagcaagcaccgatcatcagcgccaaatatttagccttcattttttatcccttaagtttgatgtataccagataagatttgctaaaaaccccatcgaccggctattagtagagtcttgttattacctggatatctggcgcattccattatgtttttctattaattatttatgatttttagtttatgtgatcaatacactctggcatcgtgagttatccgccttttctgtttaccagatcacattttattatttaacaggccaggcattacttaatttaaaatgtattctcgccgcaaatataataaacgcaaattatattaagcaataaaaaaccccggccataaaccggggttaatttaaatactggaaccgcttaccaataagactaaatatgcaattcctgcagtttttctttcggcagcgccagctctttattgctgttcacgcgcacatcacgctccagaatatgacgggcaatgtcctgcgcttcactgagcgagtgcatctgatacgtaccgcactggtaaacgttcagctccgggatctggttttgatcctgcactttcagcacatccgccatcgccgctttccaagcgtcggcaacacgctgctcgtccggcgtgccaatcaggctcatgtaaaagccggtgcggcagcccatcggcgagatatcgataatctcaacgccgttaccgttgaggtggtcgcgcataaagccagcaaacagatgctcaagcgtatgaatccctttttccggcatcacttctttgttcggaatgcaaaaacgcagatcaaacacggtgattgcgtcgccatgcggggtgttcatcgtttttgcaacccggaccgccggcgcttgcatccgggtatgatcgactgcgaagctatctaataatggcatttagtcacctccgataattttttaaaaataaactgaactctttgttccggggcgagtctgagtatatgaaagacgcgcatttgttatcatcatccctgttttcagcgatgaaattttggccactccgtgagtggcctttttcttttgggtcaggcgtgtttcgcaagccacgcggcaaacggctcggtatccgccgcctcaatctcctgctgacgacgtactgaagcgtcacgttcagcaataaactcttcttcctgtaaaatctccagcggctcttcgcgtaacagattacggtaagcctcaccgaacgctttcccagtgccgccaatgccttcatcaatcatagaccgtaagattcgggcagagaatgtcagttcaggattatcaaagcaggcgaccaactcatcacacaccttttgatactcctctcccccgtggatactgtccagcgtttgcgccacgcgtttcagatcgcggaagagatctttccctactttaggcagcgggaactgcgcggtttcacagccaatccccagggtaaggcccggcttacgcccttccagaataacgcgattccagttagtacgcgtacataacagctcatcgctactcatttccggcgcatcggccaatacgcaccagaccataaacagatcgaggaagcgcacctgttgctcgtctacgccgatcggtgagaacggattaatatcgagagaacgaacttcgatgtactcaataccaccacgcagaagcgcatctgaaggcgattcgccgctgcgcgtcacgcgcttgggacgaatgggcgcgtacagctcattttcaatttgcagaacgttgctgttaatctgtagccgcttaccgtctttttccacaccaatccgcgcgtactcttctgacggcgttttaatcgcccgtttcagacctgcaacgtattcatgtagatcgttaaacgtaatacccagattgctttgcgacttattggtatagcccaaatcactcaaacgcagcgacgtcgcatatggcaggtagtacatgccgcagtccgttttttcaaacggtaatgtggttggcttcccttgcaggaaagaggaacaaatggccggagacgcgccaaacagataggggatgacccagccaaaacggtaatagttgcgaatcagacgaaaatagccggcagaaattttttcttttgccgcttcgccttccgtaacgccgcatttcgcctgccagaacgccatcggtaatgaaaaattgtaatgtacgccggaaatggtttgcatcaaagcgccataacgatttttcagcccttcgcgatagagcgtcttaaagcgcccggtatttgatgtgccgtactgcgccagctctatgtcctgcccttccgcaatatagcagggcatacttaatggccacatccgctcatcgcccagtttcctggccgtataccgatggagatcgcgcataaaggtgagcatatgctggatatcgccatcgactggcgtaataaactccagtagggcttccgcaaaatctgtggtaatccatttatgggtcagcgctgaacctaacgcttcaggatgaactgttgtcgccagcgtgccatcagcattgacacgcagcgtttcgcgctctaacccgcgctgtatcccctttaacgcctgaggatgtttttccagccaggccagagcctgtgatacgtccgggatcaaattgacctcccgcctgtccaaatcgttttaataagcataactgtaatggcggccatacatgccaaacctacaattattaccaccacatcatgccctgaaccgtcgccgctgcgagcgcaacatagcgcagcgccttaccaagacacaaaaaaaagatcgtccgcccccacgggatgcgcatccatcccgctaacaggcacaacaaatcaccgatgaccggcatccagcttaataatagtgtggctgcgccataacgctttagccagccagtcgctttttcctgccaacgcgacgttttgcgcagcggaaagaaacgcccaagaataacgttagttacccctccaaggctattacccattgttgctgttaagactaagacccagggatgactgacgccggagaccagcatagcaaccaaaaccacctcagaattaccgggtaacagcgtcgcgctgagaaaactactggcaaacagagacaggagcgacagtccgtcactcacaatagtcggacatccacggcatccattcccgccgcccgcgccgcctgtaaaccaaaatcggcatcttcaaataccacgcactgcgtcggcatgacgcccatccgctgggcgcacaataggaaggtgtcaggcgcaggtttgtgatgctgtacgtgatctgccgccacaaccgcatcaaaataacgacgcagccccagatgcgctaacaaggcttccgcgatagcgctttcgctaccggtaccgaccgacatgggacgccgcccatgccacgctttgaccacctcaaccagcggcagcggttctacgcagtccagcaggatgctttttaccgcgtcggttttctcacgcgccagtgacaggggatcaagatcggcatggttaagctcaatgattgactgggcgataagccaggttggcgaaccgttaagcgcgaccattgcctgttcatcaaaacgaagaccatagcgccccaaaacctcacgccacgctttgcgatgcgtgggttcggtatccaggagagtaccgtccatatcaaaaatcaaaccagcataacgtgcgtacatcgtgttctcgcaaaccgaataaccagacagtactttatcgcaattggttgattttgtcgctaatagagatgaagaggtatattcaggataagggggaaaagcgattgcagggcagtaacgtatccgggaggattactcgcccttcgggccgttgctgatgcaacgttatccttctgatgccagcggtgattaccgctatcttatctgcatcttcatcgctgaaagtatggagaatatggtgcatccgggaggattactcgccttacggctcgcccttcgggccgttgctgacgcaacgttatccttcctggtgcctgcggtgattaccgctatcttatccgcatctttatcgctgaaagtatggagaatatggtgcatccgggaggattcgaacctccgaccgctcggttcgtagccgagtactctatccagctgagctacggatgcattgggaaacttgctttactgctgatattgataccgcggtgaaagccgtatcaattaagagatggtgtatccgggaggattactcgccttacggctcgcccttcgggccgttgctaacgcaacgttatccttcctggtgccagcggtgattaccgctatcttatccgtatcttcatcgctgaaagtacggagaatatggtgcatccgggaggattcgaacctccgaccgctcggttcgtagccgagtactctatccagctgagctacggatgcatcggaaaacttgctttactgccgatattgataccgcggtgaaagccgtatcaagtaagagatggtgcatccgggaggattcgaacctccgaccgctcggttcgtagccgagtactctatccagctgagctacggatgcatcgggaaacttactttactgcagattttgataccgcggtgaaagccgtatcaagtaagagatggtgcatccgggaggattcgaacctccgaccgctcggttcgtagccgagtactctatccagctgaagctacggatgcaaatggcggtgaggcggggattcgaaccccggatgcagcttttgaccgcatactcccttagcaggggagcgccttcagcctctcggccacctcaccacacgcctcttacgagtgcttcgaagaacttgttctgctcatcgtcgctgcgtggcgcacatattactttctgggacttataagtcaaacaatttttccagagcttttatcgtttgcacacttcacgctcaattagtctataaaaaagccaaaaagagtgttttatcaacagataatttgatgacacgctggccgccaaaagcgcaccatatcaacagtgaggttgaaaaaagtcatgaggggacaacgcgggcgagcgagaagagaggctgcgtctcacccgaaaagtgagacgcgaaaaccttagtaactggactgctgggatttttcagcctggatacgctggtagatctcttcacgatggacagaaacttctttcggggcgttcacgccaatacgcacctggttgcccttcacccctaaaactgtcacggtgacctcatcgccaatcatgagggtctcaccaactcgacgagtcagaatcagcattctttgctccttgaaagattaaaagagtcgggtctctctgtatcccggcattatccatcatataacgccaaaaagtaagcgatgacaaacaccttaggtgtaagcagtcatggcattacattctgttaaacctaagtttagccgatatacaaaacttcaacctgactttatcgttgtcgatagcgttgacgtaaacgccgcagcacgagctgcggcgccaacgaacgcttataattattgcaattttgcgctgacccagccttgtacactggctaacgctgcaggcagagctgccgcatccgtaccaccggcttgcgccatgtccggacgaccgccacccttaccgcccacctgctgagcgaccataccaatcaattcccctgctttaacccggtcggtcacatccttcgacacgcccgcaatcagagaaaccttaccttcaacaaccgttgccagtacgataacggtagaccccagttgatttttcagatcatcaaccatggttcgcagcattttcggctcaataccagcaagctcgctgaccaggagcttcacgccgttgagatcgaccgctttactggaaagatttgcactctcctgcgctgcggcctggtccttcaactgctgcaactctttttccagctgacgcgtacgttccagcacggcacgcactttgtcgcccagattctggctgtcgcccttcagcagatgcgcaatatcgtttaagcgatcgctttgcgcgtgaacggtggccatagcgccttcaccggttaccgcctcaatacgacgaatgcccgctgcggtgccggactcagagataatacggaatagaccgatatcaccggtacgactggcgtgagtaccgccgcacagttcggtagagaaatcgcccatgctcagaacgcgtacacgttcgtcgtatttctcgccaaacagcgccatggcccctttcgccttcgccgcgtcgagatccatgatgttcgtttcaatcggcaggttgcggcgaatttgcgcattcaccaaatcttcaacctcacgaatctccgacggcttcatcgcttcattgtgcgagaagtcgaagcgcagcactttatcgctaaccagcgaacctttctgcgcaacgtgtgtcccaagcacctggcgcaacgccgcgtgcatcaggtgcgtggcggagtggttcagacggatacgtgcgcggcgcgcttcatctacgtcagcctgtaccgcatcgcccactttcagagcgcccgcagacaatttgccgaggtgaccaatcgcctgaccatatttttgcgtgtcgtccacagcgaaagtaaatccagcgcctttcagctcgcctttatcgccaacctgaccgcctgattccgcatagaatggggtctgatccagcacgacaacagcttcctgtcccgcgttaatcgcttcaaccgctttaccatcgacaaacagcgcagtcactttgccgttcagttccagatggtcataacctttaaattcagaagcgctgtcaacgcggatcatcgcgttgtagtccgcgccaaaaccgctagcttcgcgcgcgcgacggcgttgctcttccatggcggcttcaaaaccggcttcgtcgactttgatgttgcgctcacggcagacgtccgccgttagatcgaccgggaaaccataagtatcatacagacggaaagcggtttcgccgtccagggtgtcgccctgcaatttcgccagttcttcatccagcagcgccagaccgcgctccagcgtacgagcgaactgctcttcttccgttttcagaacctgctcgacctgcgcctgctgacgtttcaactcttcgcctgcggagcccattacctcaatcagcggcccaaccagcttgtagaagaaggtctcttttgcgcccagcatgttgccgtgacgaaccgcgcgacgaataatgcgacgcagcacatagccacggttttcattcgacggcagcacgccatcggcaaccaggaatgcgcaagaacggatgtggtcggcgataacgcgcagcgatttattacccaaatcggtggagccggtgactttcgctaccgcttcaatcaacgtgcggaacaggtcgatgtcatagttagagttaacgtgttgcagtaccgcggcaatacgctccagccccataccggtatctacagacggtttcggcaatggttccatcgtcccgtcagcctgacggttgaactgcataaagacgatgttccagatttcaatatagcgatcgccgtcttcttccgggcttcccggagggccgccccagatgtggtcgccatgatcgtagaagatttcggtgcacggaccgcagggaccggtgtcgcccatctgccagaagttatccgatgcgtatggcgcgcctttattgtcaccgatacggatgatacgctcgcgcgggatgccgacttctttttcccagatctcataggcttcgtcgtcggtttcatagacggtgacccataagcgctcttttggcagagcaaaccagttttcgccggtcagtaattcccatgcgaactgaatggcgtcgtgtttgaaataatcgccgaagctgaagttgcccagcatttcgaagaaagtatggtgacgtgcagtgtatccgacgttttccagatcgttgtgtttaccccccgcgcgtacgcaacgctgggaagtggttgcacgggaataattacgtttatcgagcccaaggaaaacatccttgaactggttcatcccggcattggtaaacaacagagtggggtcattgttaggcaccagggaactgctggcaactacctgatgccctttactatggaaaaagtcgagaaacgcctgacggatctcagcggtgctcttgctcataattatcctgaaatcaagctacactccatccttcaggccgcctctgcgttggctgcgagtttcccggtcacgcgttcccgaggctcacttgccgctttaatgcggcttgaatgattttgtgtatttaaggaatattcgtcgcagacgctgttcgccgttaagcaacccgcgtccagacggaaaaagtgggaataagataagttttctttaccgggaagtaaaatcccgtatgcgctcaatctgcaaaatttcgccatatttgctggatatcgtccatcagatacccgcgatagagcaaaaagcgctgtaccttaaccttttctgaaaagtttgaagggagcggctcgccatatttgcgaacggcctgttcacgtgccatttcactccagtcaatttcacattctcgcatcgctttttcagtcgattcacgggaaatgcctttctgattcaactcctggcgaatacgcgccgggccatagcctttgcggctacgactggcgataaagcgcatcacgaagcgctcgtcatcaagatagtggtgttcgtggcaccaggcgatcacgcgttcataatcgtctgccgtcgcatcaatctcttccggcccatttttgcccatcaccggcgcggagagtttacgccgtagttcctgctcgctgtgatcgcggacagcaagaatacgtaccgcacgatcaaggagacgagcataagcgggacggcgcgatgtgggttcactcataaaaaaccttaacaggggtaaatgccaaaagggccgcataaatgcagcccttgatggtaatttaacgttttgctgaatggcggcttcgttttgtccgacccaccatcacctgatgattaaaaatcttcgttggtttctgcaacgccttcgctatcgtcaacggcgaaatcgggcgtggcattctgattactcaacagtaattcacgcactcttttctcgatctctttcgctgttgccgggttctctttcagccaggtagtcgcgttcgctttaccctggccaatcttctcgccgttgtagctgtaccatgcgcccgctttctcgatcagcttctctttcacgcccaggtcaaccagttcgccatagaagttgatgccttcgccgtagaggatctggaactcggcctgcttaaacggcgcggcgattttgtttttcaccactttcacacgcgtttcgctacccacgacattatcgccttctttcaccgcgccaatacgacggatatcaagacgaacggaggcgtagaatttcagcgcgttaccgccggtggtggtttccgggttaccaaacatcacgccaattttcatacggatctggttgatgaagatcagcagcgtattggactgtttcaggttccccgccagcttacgcatcgcctggctcatcatacgcgccgcgaggcccatgtgagagtcgccgatttcgccttcgatttccgctttcggcgttagcgccgctacggagtcgaccacaatgacgtccaccgcgcctgaacgcgccagcgcgtcacagatttccagcgcctgctcgccggtatccggctgagaacagagcaggttatcgatatcgacgcccagcttgcgtgcgtaaacagggtcaagcgcgtgttccgcatcgataaacgcacaggttttaccttcacgctgcgcagcggcaatcacctgcagcgtcagggtcgttttaccggaagattccggcccgtaaatttcgacgatacgccccatcggcagaccgcccgcaccgagtgcgatatccagtgaaagcgaaccggtggagatagtttccacatccatagaacggtcttcacccagacgcatgatggagcctttaccaaattgcttttcaatttggcccagtgctgccgccaacgctttctgtttgttttcgtcgatagccattattactcctgtcatgcaacttggtattgaaccggatagtgaattcgtactgttgaagcaattatactgtatgctcatacagtatcaagtgttttgtagaaattgttgccacagggtttgtagcgcgtatgtcgtcgcctgtcgacgcaccgattcacggtcgccgctgaagcattcccgacgcgtaatcccttctccactgacgctggcgaaagcaaaccacaccgtaccaaccggcttttcttcactgccgccatccggcccggcaatcccgctaatagcgacagcaaaatcggcgcgagcggccttcagcgccccgatcgccatttcgaccactacggattcgctgaccgcgccatgctgcgccagcgtctcttcacgcacgccaatcatctgcgctttggcttcattactataggtgacaaagccgcgttcaaaccaggcggaacttccggcgatgtcggtaatggctttcgccagccagccgccggtacaggactccgctgtcgttacggtcgccccgcgcgcttttaacgccagcccgacctgttcgctaagccgcatcagttcactgtcagtcatcatgacctctgtcagttagaaatcctgccgcacaagatagcactttctcaccagagatggggacgagctgtcgattttacgagtcggattccgaaaaaatgccagcaggttatttatgcagaatgaaagaggtagcacatgactaaatagcagtactatgtcgctaaatttacacgcacggagagaaagcaaggatgtcactcaaaaaaacggaaagcgcacagcacaaactgaaacaaacctgtcaactacggctgtggttaattgtgggtggagtatgttcattaggaatgggagtactgaatatattgtcgtcaggctattttgaaccgtatgacggcggtcaaattatcttaggcctgggatgtctgggttatagtctggcactatcaaaaaagatatcccacttgcaagcccaaaaagccatagtaatagcggaggggggctcccctccctaagcgtaaattagcgcacccgcgccagcgctaccgcctgccccagttgccaaaccgccatcgcataatgcgtgctgtggttatatcgggtaatggtgtagaagttcggcaggccgtaccagtactggtatcccgtaccgatatccagacgcagcaggctggcttcctgatgattgcccaacgattgctgcggcgttaagcctgcggcggcaagctgagagatgctgtattttgttttgaaaccattcgccaacccaggcgcctgaccactcgccggcaccgcaaccatatcgcctttcacccaaccatgcgccttgaaatagttcgccacgctgccgatggcatctaccggatcccacaagttaatgtgcccatcgccattgaaatcgaccgcatattctttataggaagacggcataaactggccgtagcccatcgcgccggcaaaggaacctttcagattgagcggatcgtcttgctcatcgcgcgccatgagcaggaaggtttccagctcgccggagaaatattccgcccggcgcggatagttaaatgacagcgtcgccagcgcgtccagaatccgtgttttccccatgatacgtccccagcgggtttccacgccgatgatgcccacaatgatttccggcggtacgccgtatacctgccaggcgcggttcagcgcgtcttcatactgattccagaacgcgacgccgttttgcacgttatccggcgtaataaattgtttgcggtagcgcaaccaggcgccatttggtccggcgggcggctgagtggtcggcgcttgtctgtccatcagacgcagaacgtaatccagtcttttagactgcgagaggatctcttgcagctgctgacggtcgaaaccgtgtttactgaccattttatcaatgaactgctgcgcattagggttgttggcgaagtcgccgcccatttgcatgacgttatgctgcggctcaagcaggaagccgccggaaggcgtgcccgtcgtcgcttgagtctcggaagattttggcgtgctgctacaggcagcaagcaatacgcaaagtggaagtaacgctacataacgacgcttgaacatgagacatccattaaacaaattcagtcagggagaagtatggtaaagcatccccccgccgcacaaggaagcggcacaagagaataaatcacctttcccctctctccagtttgtatctgctcctccactccctcaatctttcaagttaaaatatttttcttttattttgagatcaaaataacacttttatacctttcaacatgattacaatgagcaggaagttagcaagaaaactaaaaaccctacaggagagaacaatgatcgaaaccattacacatggtgcggagtggttcatcgggttattccagaaaggcggtgaggtgtttaccggtatggtgacaggtattcttccgctactgataagcctgctggttatcatgaatgcgctcatcaattttatcggccagcagcgtattgagcgttttgcccaacgctgcgccggaaatccgctatcccgctacctgcttttaccgtttatcgggacgtttgttttttgtaatccgatgaccctgagtctgggacgctttatgccggagaagtacaagccgagctattacgcggcggcctcctatagctgtcactccatgaacggtctgtttccgcatatcaatcccggcgaactgtttgtttatctgggtatcgccagcggactcaccacgttagggcttcctctcggcccgctcgcggtgagctatctgctggtaggtctggtgacgaacttcttccgcggttgggtcaccgatctcaccaccgctatttttgagaaaaaaatggggattcaacttgagcagaaagttcatctgacaggagcggtatcatgacacgggttcgcattgagaaaggtgccggcggctggggcggcccgcttgaactggacgttacgccaggcaaaaagatcgtctatatcacagccggtacgcgcccggcgatcgtcgacaaactggcgcaactaacaggctggcaagcggtggacggctttaaagaaggcgaaccgccggaagcggagatcggcgcggccattatcgactgcggcggtacgctgcgctgcggtatctacccgaaacgccggattccaaccattaatattcactcgacgggtaagtccggcccactggcgcagtatattgttgaagatatttatgtctccggcgtaaaagaagaaaacattactctagtcggcgaaacatctgccagaccccagcctgccaaaacgacattaggacgtgactacgacaccagcaaaaaaatcaccgagcagagcgacgggctgctggcaaaagtcggtatgggaatgggttctgccgtggcggtactgttccagtccggtcgcgacaccattgatacggtcctgaaaacaattctgccgtttatggcgttcgtttcggcgctaatcggcatcattatggcctcaggtcttggcgactggatcgcccacggcctggcgccattagccagccatccactggggctggtgacgctggcattgatctgctctttcccgctgctgtcgccctttctcggcccaggcgcggttatcgctcaggttattggcgttctgatcggcgttcagataggtctgggcaatatccccccgcatctggcgctgcccgccctgttcgcgattaacgcgcaggcggcctgcgactttatcccggtcggcctgtcactggcggaagcgaaacaagacaccgttcgcgtcggcgtaccttctgtgctggtcggacgcttcctgaccggcgcgcccacggtacttatcgcctggtttgtttccggctttatctatcaataagaggttcagacatgagcgtgatttatcaaaccaccatcacccgcatcggccagagcgcgatggaggcgctcggcgaaaagatgctgattacgtttcgggaaggcgcgccggcggatatcgaagaattttgcttcatccattgtcatggcgaactgaccggcgcgctgcagcctggcgcgcggtgtgaactgggccaacattgctatccggtcacggcggtcggcagcgtagccgagcaaaacctgcgtgaactggggcatatcaccttgcgctttgatggtctgcgcgaagcggaatttcccggcaccgtacacgttgcggggcctgtaccggacgatatcgcgccgggctgtattttgacgtttgtcgcttaaggagaaaaaacatgaatcaagttgccgttgtcattggcggaggccagaccctgggggcattcctttgccgtgggcttgcagaagaaggataccgcgtggcggtcgttgatattcaaagcgataaagccgcgaatgtcgcccaggaaattaacgccgattttggcgaaggtatggcctacggttttggcgccgacgccaccagcgagcagagcgtgctggcgctgtcccgcggcgtagacgagattttcgggcgcgtcgatctgctggtttacagcgcgggtatcgccaaagcggcgtttatcagcgatttccagttgggcgattttgaccgctcgctacaggtgaatctggtgggctatttcctctgcgcccgtgagttttcccgcctgatgatccgcgacggcattcaggggcgcattattcagattaactctaaatccggcaaagtgggcagtaaacacaactccggctacagcgcggcgaaattcggcggcgtggggttaacccagtctctggcgctggacctggcggaatacggcattaccgtacactcgctgatgctcggcaacctgttgaaatcgccgatgttccagtcattgctgccgcaatacgccactaaactgtgcattaagcccgacgaggtggaacagtattacattgataaagtaccgctcaaacgcgggtgtgattatcaggatgtgctgaacatgctgctattttatgccagcccgaaagcgtcttattgcaccgggcagtcgatcaacgtaaccggcggtcaagtgatgttctgaccgtgaattgccggatggcgccgtaggccggataagacggttacgccgccatcaggcaaaacaacaggagcacattatggtttccactctgattaccgtcgccgttatcgcctggtgtgcacaactggcgctgggcggctggcagatttcccgctttaatcgggctttcgataaacttagccaacagggacgggtcggcgtcgggcgctccggcgggcgttttaagccccgggtggtggttgccgtggcgctggacgaacagcagcgggtgacggacactttattgatgaaaggccttacggtattcgccagaccggttaaaattgccgcaatgcaaggaaaacatttgcatgaattacagcctgatgtgatctttccccatgattcgctcgcgcagaatgcactatcattggcgcttaaactgaaacatgggtaatttcgttgtgaatgcgaatagcttgcgaaattatcattttgcaacctataccctaaataattcgagttgcaggaaggcggcgacgcagcgaatcccctggaacgtacatcaatacgtgaccggggtgagcgaggaaagccaacgcacatgcagcgtgaagtattacgggtaaatacataagtcagggtaatcacgcctatgaaacctcgtcagcgtcaggccgcgattctggagcacctgcaaaaacagggaaaatgctcggttgaagaactggcccagtactttgacacgacaggcaccactatccgtaaagatctggtcattctggaaaatgccggaaccgtcatccgcacctatggcggcgtggtgttgaataaagaagagtccgatccgcctattgatcacaaaacgcttatcaacacccacaaaaaagcgctgatagccgcagccgctgtgaaatatatccatgatggcgattccattattctggacgccggaagtaccgtgttacagatggtgccgttgctttcgcgttttagcaacatcacggtgatgaccaacagcctccatattgttaacgcgctatcggaactggacaacgaacaaactatcctgatgcccggcggcaccttccgtaaaaaatcggcgtcgtttcacggtcaactggcggaaaacgcctttgagcaattcagctttgataaacttttcatgggaactgacggtattgacctgaatgtcggtgtgaccacgttcaatgaggtttacaccgtcagtaacgcaatgtgcaatgcagcacgcgaggtgattctgatggcggactcctcaaaatttggtcgtaaaagccccaatgtggtgtgcagtctggaaaccgtcgacaaactgatcacggacgcggggatcgatccggcatttcgtcaggcgctggaagcaaaagggattgaagtaatcataaccggagaaagcaatgagtgatgcactactaaacgcgggccgtcagaccttaatgctggagctacaggaagccagccgtctgccggagcgtctgggcgatgattttgtccgcgccgccaatatcattattcactgtgaaggcaaagtgatcgtttccggtattggtaaatcaggtcatattggtaaaaaaatcgccgcgacgcttgccagtaccggtactcccgctttttttgttcatccggcggaagcactgcatggcgatctggggatgattgaaagccgcgacgtgatgttatttatctcctattccggcggcgcaaaagaactcgacctcatcatcccgcgtctggaagataaatccgtcgcgctgctggcgatgaccggtaaacctcactctccgctggggcgagcggcaaaagccgttctggatatttccgtcgagcgtgaagcctgtccgatgcatctggcgccgacatccagtaccgtcaatacgctgatgatgggcgatgcgctggcgatggcggtcatgcaggcgcgcggttttaacgaagaagatttcgcccgttcgcatccggctggcgcactgggcgcgcgtttgctcaataatgtgcatcacctgatgcgccagggcgatgcaataccgcaggtgatgctcgccaccagcgtgatggatgccatgctggaacttagccgtaccgggctggggctggtggcggtttgcgatgagcaacatgttgtgaaaggcgtctttaccgacggcgacctgcgtcgctggctggtaggcggcggcgcgctcaccacgccagtaagcgaagccatgacgcccaacggtattacgctccaggcgcaaagccgcgccattgacgccaaagagctcctgatgaaacgcaaaattaccgccgcgccagtggtcgatgaaaacggcaaactcaccggcgccattaacctgcaggatttctaccaggcggggattatctaatccttcagtcccagacgcttcgccagccgatgcaggttggcgacgtcggtttccagcgcccgcgcactggccgcccagttgtgattattttgcgccagcgcctggcgaatcatctctcgctggaagttctccgtcgattcgcgcaaattgcggcaggccggcaacgccagaaagctttccgcagacggcgcgggtaaaacgtcctctgacaaggcaaaatgctgctcctccagtaccacctcatcccctgcccgggtcgctctcgccagtacaaccgcacggtgaatggcatgttccagctcccggacgttgcccggccagccatagttgagcaaatggcggcgcgcgccgggactcagtaccacgcgggacagccccagccgcagtcggcactgctcgcaaaaatagcccgccagcaacaccacatcatcgccgcgctcgcgcagcggcggcacaaagagcgggaaaacgctcaggcgatggaacaggtcggcgcgaaaacgccccgccagcacctcttcacgcaggtcacggttggtcgccgccaacacccgcacatccacgcgcaggctacgatcgtcgccgacgcgctgaatatcgccatactgcaacacgcgaagtagcttggcctgtagcgccagcgacagttcgccaatctcatccagaaacagcgtaccgttatccgccatttcaaacttaccgctacgattactgatagccccggtaaaagccccttttacatgaccaaacaactcgctctccgccacgctttccggcagcgcggcgcagttgagatagaccagcggattgaccgctctgggggagccctggtgaatagctttcgccaccagctctttaccggtccccgtttcaccgccgatcagcacgttaagatcggagcccgccacaatctcgatctcttttttcaactgcgtcatcgccggcgacagaccgatcatgtgcgtctcttttatcggttcaaacacgcctgacgaccccggcagcatgttctggctttccagttgttcaattaacagcgcattactcaatgccccggcggccagcgcggcgacaagccgtagttcttcatcgctaaatacctcgaactgctccggcgtcatagcatcaagggtcagcgcaccgatgaggttctgtccggcaaacagcggcagaccaacacaggcgtggactttcaggctttcctgtccgggaattaacccgtcatatggatcgggtaaatcgctatcagccggaaaacgcaccacgtcccccgcgcgggcgatggcttccaggcgcggatgcccttccagggtaaaacgtctgccgaggacgtcctgcgccaggccatcaatcgccagtggaataaattgtcgtgattcataacgcagcagcgccgaggcgtcgcacgccagcacctgacgcagcgtagtaatcagccgctgaaaacgatcctgatgcccaatgccgcgttgtaactcaatggcgatgcccgccaatacctccacggaaaaactcatggttacctcattgtcattttgacaatctatagtgtcatattgacagcatcatttatagtctttttgactataccaaaaatacaaaattattataatttcatataaatcaataagatgtaaagttggcacactacctgcaataagcaaaacaactttttgcaaacgttgaatgaattgaggtggttatgtctattctggttaaaaataatattcattgggttggccaacgcgactgggaagtacgtgattttcacggcactgaatacaaaacgctgcgtggcagcagctataacagctatctcattcgtgaagaaaagaatgtgctgatcgataccgtcgatcataagtttagccgtgagtttgtgcaaaatctgcgcagtgaaatcgacctcgcggacatcgactacatcatcattaaccatgccgaagaagaccatgcaggcgcgctgaccgaactgatggcgcagatcccggacacgcctatctactgtaccgccaacgccattgactctatcaacggccatcaccatcacccggaatggaattttaaggtggtgaaaaccggcgatacgctggatatcggcgacggcaagcagttgatcttcgtggaaacgccgatgctgcactggccggacagcatgatgacctatatgaccggcgacgcggtgttattcagcaacgacgcctttggtcagcactactgcgacgagcacctgttcaatgatgaagtggaccaaactgaactgtttgaacaatgccagcgctactacgccaatatcctgacgccgttcagccgtctggtaacgccaaaaattaccgaaatcctcggcttcaacctgccggtggatatgattgccacctcacacggcgtggtatggcgcgacaacccaacgcaaatcgtggagctgtatctgaaatgggcggcagattatcaggaagatcgtatcactattttctacgataccatgtcgaacaatactcgcatgatggcggatgccatcgcacagggtatcaatgaagtggaccccaacgtggcggtcaaaatctttaacgtcgcccgcagcgataaaaatgaaatattgaccaacgtcttccgttcgaaaggcgtgctggtcggcacttctaccatgaacaacgtgatgatgccgaaaatcgctggtctggtggaagagatgaccggcctgcgctttcgcaacaaacgcgccagcgccttcggttctcatggctggagcggcggcgcggtggatcgactgtccacgcgcttacaggatgccggttttgaaatgtccctgagtctgaaagcgaaatggcgtccggatctggatgcgctggagttgtgccgtcagcatggtcgcgacatcgcccgtcagtgggcgcttgctccgctgccggaaaccacacagaaaaccgcgccagtcgaagaaaccacaacctgcaccgccgcagacctcggccccaaaatgcaatgcagcgtatgccagtggatttacgaccctgcgctgggcgagccgttgcaggatgtcgcgccgggtacgccgtggagcgacgtgccggataacttcctgtgcccggaatgttcattaggtaaagacgtgttcgacgtactggcgacggaggcaaaatgagtcgggggatcatcattattgggtcgggcttcgccgcccgccagctcgtcaaaaatatccgtaaacaagatgcgcatgtgccgttaactctgattgcggcggacagcatggatgagtacaacaagcccgatctcagccacgttatcagccagtcgcagcgcgccgatgatctcacccgccagttagcgggggaatttgctgaacagtttaatctacgactgttcccgcatacctgggttactgacattgatgccgatgcccatgtggtgaaaagtcaggataagcagtggcagtacgacaagctggtactgacgaccggggcgacagcctttgtgccgccgattgcaggacgtgagttaatgcttactttgaatagccagcaggagtaccgcgcctgtgagacaccactgcgcgacgcgcagcgagtgctgattgtcggcggcggtctcattggcagtgaattagcaatggatttctgccgcgccgggaaaacggtaacgctgatggataacgccgccagccttctcgcctcactgatgccaccggaagtgagcagtcgcttacagcatcacctgaccgatatgggggtgcatctgctgctgaaatcgcagttgcaaaaactggagaaaaccgaagccggtatccgcgctacgctggtaagccagcatagtattgaggtcgatgcggtgattgccgccaccggcttacgcccggagaccgctctggcgcgccgcgccggggtagccgtcaaccgcggcgtctgcgtggatagctatctacagaccagtcacccggatatttatgcgatcggcgattgcgcggaaatcaatggtcaggtgctgcccttcctgcaaccgatccagttaagcgcgatgtacctggcgaaaaatctgctcggcggcaacgcgccgctgaagctaccggcgatgctggtcaaagtcaaaacgccggaactgccgctgcatctggcgggagaaactcagcgccgcgatttaagctggcagattaccgcagaatctgacggtatgattgccaaaggcatgagtggagaaggccagctacgcgcctttgtggtgagtgaagaccgcatgaaagaggcctttgcactgctgaaaacgttgtcggtataagcctgtgatgccggatagcgccgcttcgcgtcttatccggcctacgagtgagcatctgtttacacgccggataaggcgcagccgccatccggcgccctacacttcccttaacgctcgcgctgcggcaatcacgccctgtccaaacgacagtccgccgtcgcccgccggtaaccgctgcggaaataacaatttaaaatcagaaagataaaaggcaagacgcgcgcgcagtaagcggttgtgtatcaccccgccgctgaagaccagagtggttatcccccgcgccgtagcctgttggcgcattagcgtggcaaacccgcacgccagcgcatcatgaaaagcccaggcgcgttgcgcgggcgtggcctgccagttcaaccattgccgccagaaaacagcgacgtccagttgagcgccgttaagcggcatcgttaccggatactcaacgttagcgcattgagaggccagcgcctccagcgcgcaggcggcctcgccctcatagctaagcgatgctggcgcgcagcgaagcgcggcagccaccgcgtcaaacaaccgcccgcaggaagaggccaacggggcattgacgccgcgctcaatggcgcgcgccaggacactccagttttgctgttgcagccccgctgtctccgggtaattctgccagtccggcacaaagcgcaggcactgcgctaacagattacgccacggctgtttggcagccagatcgcctcccggcagcgccacggcgggtaaaccgcctaaatgttcgcattcgcgataattgacccgcaaacattctccgccccatagcgcgccattctcacccatgccgataccgtctaccgtcagggcaatcacctctccgccgtccagcggccaaccatgctcggccaggcaagccgccgcatgggcatgatggtgtaacaccgtctctgtcggcagacgcatctcactggcccactgactggaaacatagcccggatgcgcatcacagacgatacgctctggcgtaaaatcgtagattgactggatcaaacgcaatgcctcgcgccactgcgcctggataccgtcatcgctgagatcgcctaaatgttggctgacaaccgcctgttcgccgcgtaccagacagaacgtgtttttcagatccgcgcccagacaaagtatcggcggcacatcgcgaaatccgggcggcaacgcaatcgcgtccggcacgtatccccgcgaacgacgcagcatttcgccgctgtcgcgcacgacagagtcgtccatgcgctgtacaatgtcgcgattgtgcaacagaaaaccatcggcaatatcgtgtaaatcgtccagcgcctgttcgttggtgatggcgggcggtttgccgctcaggttgccggatgtcatcaccagcgggtaattgagtgcctgcaacaagagatgttgcaatgggttggctggcagcatcacgcccacttccgtaagtcctggcgcgatgccctcactcagcgaaggtacatactgcttatccaccagtacaatcggggccgctggcgtggtcagcagcgaacgcgccgcggtcggcagcgtttgcgccgtgggcaacatcaccgccaatggtttcgccggacgatgtttacgcgcccgcagcatcgccactgcgttatcgttgcgcgcgtcgcaggccagatgaaaaccacccagccctttaacggcaataatgcctccggcgttcagttgggcgaccgccgcctgcaaagccgcctctttttccgctcgttcatgttggctccgccactcaagatgcggcccgcatgacggacaggcaacgggctgggcatgaaaacggcgatcgtacggatcgcggtattcgctgtcgcattccggacacaagggaaacgccgccatcaccgtaaatggccggtcatagggcatagcgcgaataatggtgaagcgtggtccgcagtgggtgcaattgatgaaaggataacggtagcgccgctcgcctggggtattcatctcggcaagacatgccgggcaggtcgccgcatccggcacgatttgcgtgttcatcgaaccgcctgcgctctgacgaatggtgaaatccgtcggtgcgcgctcccataccaacgacgcgtgttcaacgctgtcaatgcgcgccagcggcgggcaatcctgatagagcgcggcaataaattgcgacggatcttccagcagccgaacgacgacgccgtcgccgtcattacacacgtcgccgtgtaattgcaactgctgcgccagctgccagacaaaaggacgaaaaccgacgccctgtactttgccccgaatgcgtagctgtacgccggaaggtgtgtctatcgccatcttattttcccgccatcatcgaacccggatgcctgatggcgcgacgcttatcaggcctacaaccgcacggaccgtagaccggataaggcattgatgccgccatccggcaatgctttgtggcgtattctacgcgcaatcgcagaaatcagaaaagcagcgatgccgttgaatccagcgccgcacgacggcgtttttccgcgctcagctgttcaagcttattgcggtccacgcagatgagggcgtgcgttgggcaagcggccatacaggccggaccggcttcacggtggtgacacagatcgcacttgttggcttcggctttttcggcacgcacgtttagccccgcgccgctattgcgaaccaccggacgaaccaccacttccatggcgccgtaaggacatgccactacgcaagttttacagccaatgcagcgttcctgcatcacatgaacaaagcctttgtcacggctgatggcaccattcgggcaaacgttggcgcacggcgcatcttcacactggcgacacagcgttgccgtggaaacgttcacgcctttgataacatggatacgaggtaaaaaggtttcaggggtcagcgatgcgcaatcctgattttcctgatgggatacgacgcaagccacttcacaggtacggcaaccaatgcacttactcgcgtctgcaatgatgaaacggttcatcaaattctccagcaataacagatgatgtgccgatatatacacgaatcgtgccaatttttatttcattgttatttaagaatattctttctattttcgtgagcatttacgtgtcatcgtcacaagtgtcgatgacacgtaatgtcgccagtggtggtcaagatttgcagtgatagccagccaactctgcacagaaactggcatcaatcctgattaacgcctggcaatacgttaccgcgtattaaacagcgctgcgtaagggaaagatcgtccgtttgcggattccttccggcaataggtttgataattaatttacggccaggatagtgattaaagcgggtcagcgccggataactcaaccggccaaaccagccgtgtacgcgctgccagcgggcgtccttcacctgatataaattggttatccagtagcctgagtcaaactgcatatccaacagttgcgtgcgaccattgccctgtaaatcaagcaaatcatcgacgccagtatcggtggcggtataaaacccccacggttcaaagacgcaggggcggccattcttgagaaaggtgaaaatgatgtattgcgcgctcggcgccaggcccaacccaggattgcccaaccagataaccaagtcctgaatgccgttacgatcgaggtcagcgcgataaaattgcgcattacccgccaaattaatcagccttcccaccgggacaacccacgaattaccggctctgtcttttccgctaatccgccattcgttatcttttttcggctccggcagtagcgtcacgctactgactccgacctggcgaaaatgccaggtctggtcgggcgatacagaataaggcaggatcaaaagcggcttcagcgcacgcttttgcgcatattcaccgtcgctcatcggcaggtaaccgacaacaccggtagccagtgcgcgtgcggcgaggcagagaaatagcagtccgctccatacgataatcttcacgttcttcttaccgcctatgccgggtaacacaaatccatccagaatgagtacgcattttacgcctccggcgcgtccagcgcggcaaatccgccgtttccctgccagccttccaggcgctgatagacgatgtttaccgcgtccttaatcggttgagtcatcggataataaaacccgacgatatccggctggataccaacaaaaatcacctcgccgacatcctctttcagcagatcgataaggtagttcagcggcatattgtgggtggtcatcataaacatttcggcgatatcatccggatcgatgatgcggatctcgcccggattaagtcccatatcggtggcgtcgacaatcaacagacgctgcgggcgcagttcgcgaatcgccacaatgtcgttttccggcgcgctgccgccatcgatgacaacccagttgcccttcggctgcgccgcgcacatttccgccagtaatgggcctgcgccgtcgtcgcccatcatgctgttgccgacacagagtaaaacgtcagtcacgaagcctcctcaccatcaggtagatggcgctttcctgatgaatgtcatgcagcatactgagcatcagtttgctccattcttgctgctgcggggtctgcgcggcgcgcgcctcatcaaacgcgcgcgccagcatttgcacatggttgaaatcgatgacgatctcgccatacttcggcacgccttccattttacgccgggcatcgctaccggcttccagggtggcgatccacgccagatactcatcccatgggcaggtgagcgcggcctccaggcaatcgataacccccaggtggtgaccaatcgccaggctgtaatagacaacctgctgcgcctcggcgggcgtcgcatcgttctcatcaataaacttacggctcagttgactgaacaccacctgttcgctcatcggatacgcgcctcttcaacaacatgattgagatggatgacaatttcggttaaacgcggatcgttttccgcttccagccaacgcgccacttgctgctcgccctgccccaactgtgtcaggtaatcatcggcgatctgacgaccatagcgataacccgccagccggcacgccgcgcgatccaccttcacgcgcagcggctgcaccatatccggatgcaggatctctgcgggctgatcgtccagctcacccggcgcgcgggcgtggattttctgctccagcaggccaagcgccattgcaaagccatacagcgtggcggcaggcgttggcgggcagcctggaatgtacacatccaccgggacgattttgtcggtaccgccccagacgcagtacagatcatggaagatgccgccgctgttgccgcaggcgccgtaagagatacaaattttcgggtccggcgccgactgccaggcgcgcagcgccggagagcgcatggcgcgggtcaccacgccggtaaacagcagaatatcggcatgacgcggcgacggtactactttgatgccgaaacgctcggcatcaaacagcggcgaaagcgtcgcaaagatttcgatttcacagccgttacagccgccgcagtccacgcggtaaacgtatgccgaacgcttaatatttttcagtagagacgccttcatgctggcgatggattcatccaccgtcatcggtaccggaatgccgttggcgtcacgcgggcctaataaattgctcattagctgacctctttcatatggcgagtcagttcaatacggtcggacggcaccaggcatttctgacgcttacagtccgggcaggtctcaaagctttcgcggtggttttctgctcggctgtcgccgttgtgcgcaagcagcgcaatggcgtagtcgatctctttctgtaccgcgaaaggacgattgcacacgcggcagttgcacagcgcgaagcgggactgttgcaggaagtcttctttcttccacactgccagttcgtactcttgcgacagtttgatcgccgccgtcgggcacacctcttcgcagcgaccgcagaagatgcagcggccaagattgaactgccacgccagctcattggtcgcaagatcggtttccaccgtcagcgcgttcgacgggcaggcattaacgcaggcggcgcagccgatgcactgctgcggattatgttccggcttgccgcggaagtttttatcaaccgcaatcggctccagcggataagacgaggtcgccgtgccggttttgataacttttttgataaaggtaaacatggcgattccttatttcagcggcgagtttttacgctcaatgctgtagcgctcaagttctttgtacggcacgactttgctcttcttcttacgtacatcgaccacggtcatccggtcggtacaggagtagcaaggatcgaggctaccgatgatcagcggcgcgtcggagacggtgttgccacgcagcatataacgcagggtcggccagttggcgtaggttgccgcacggcagcgccagcggtaaagcttctggttgtcgccggtcatgctccagtggatatcgtcaccacgcggcgcttcagcgaagccgagcgcaaaacggtgcggaatataggtaaagccttccaccatcagcgggccgcccggtagattatccagaccgaaatcgatcatattcagcgaggtgtagacttcgttgatacggactttcagacgagaaatcacgtcgcagccctgctcgctatgtacttccatcggcagcagaccgtagccgacaaacgggtggtcggcgcgggtgtcgcgggcgtgaccgctggcgcgcaccatcgggccgacattactgaagtcgcgggcaatttccgggtccagacggccgatacccacggtacgctgttccatattcggcgtgctcagcagcatgtccaccagctcctgcacgtcacgacgcatctgctgcgccagttgacgggtctggatcatgtcctctttgagcagatcgcggcgaatcccgccgatcaggttcagaccgtaagttttgcgcgccccggtcagtatttccgccatcttcatggaggtttcacgcacgcggaagaactgcataaagccggagtcaaagccggtaaagtggcaggcgaggcctaggttcagcaggtgcgagtgcagacgctccacttccagcagaatggcgcggatcatctgcgcacgctccggcacctgaatgcccatcgcgttttccacggaagtggtgtaggcagtgctgtgcgcgaaaccgcagattccacacacgcgatccgacaggaaggtgacttcgttataacccatgcgggtttccgccagtttttccataccacggtggacgtagaacaggcggtagtcggcatcgataatgttttcgccatcgacgaacagacggaagtggcccggttcatcggaagtgacatgcagcgggccaatcggcaccacgttatttttcttgtcacccagctcgttaatgaactcgtaggtttccgcatcggtggtcggcgccgggcgctgacgataatccatgctgtctttacgcagcggatagagttcatccggccagtcgtccggcagcaccagacggcgctcgtccggcagaccgaccgggattaaaccgtacatgtcgcgtacttcgcgctcaccccacacggcagccggcacgcgcggcgtaacggatgggaattccagcttattggcatccacttcaacacggacggtaatccagcacttggtgccctgctccatcgacagcacgtaataaacggcatagtggccgcacaactggcgttcgtcattaccgaacagcaccgacagccacccaccctgctggtagtaaagaaactccaccacttccggcagatagttcacttttaccgtaatagtcagctgatctttggtctgccaggcttcgtccatcacgacgcccggaaacgcctggtgcagcgccgcaaggtattgttgacctaatttttcttcaaacatgctcaaactctcttaaatcacgccgccagcaaggagacgaaggctaaaaacgcaaacccaaaaccggcccaggtcacgcgtgaagtggcgcaaaaacgcagtcgcgccatgctgttttcaaacagggcgatcaccagtacgccgacaatcagcttgacgacggcaatcaccagcgccagtaacagtccgcctgcgctgaaggtttccatctgtccccacggcaaaaacacgccgacgaacatttgcagcaccaccagttgtttcaggctgatgccccatttcagcaccgcaaagccgctaccgctgtattcggtcaacggcccttcctgcaactcctgctccgcttccgccaggtcgaacggcagcttgcccatttcgataaaggtggcaaaggcgcaggcgcacagcgccagaatcagcggaatactgcgcgcgacaggccagtgataaatggtatcggcgatattgctgatatgagttgaacccgccacctgcgcggctacccacagacccagcagcagaatcggctccaccagcacgccgagcatcgcttcacggctggcgccgatcgcagtgaacggactgccggtatccaggcctgcaatagagaagaagaagcgcgcaatcgcgaacagataaatcagggtgattaaatcacccagttgcggcaacggagatccaacggtgacgaccggcagcgcggtggcgatagtcagcatcacgccgaccatcacaaacggcgtcaggcgaaaaacccagccggaatcagcgggcgcaatactctgacgaccgagcagtttgataatgtcgcggtactcctgcaacacgcccggcccacggcgattgtgtagacgggcgcgcgccacgcgagtaataccggacagcaatggcgcaacggcaaatagcaccagcgcctgaattaacggataaaacacactcattttcaggctcctcgtgaaaccacaatcaccaccagcaccgccagctcaatcagcgccagacgacggaacagccccgcggccgccgcgttctgccagcccggcaccagcgataccgggttcagccatttacgcagtttgagtaccggggcaaaggcctctttcaccggcatggcgaaaccgtgcgcggtaatcaccatcgactgctcatggtcgtagccgcacacccaggccgcgccgcgagaacgcgacggcagacggttgcctttgaacatcgccataatgatgaatggcagtagcggacaggcgaccaacagcagcgtgatcatcggctgcgatacggtggtgtgcgcggtttccagcggcaacggtaccgcagtggaaatcatcggcagcagccacggcgcggcaaccccgcccagtacgcagcaaaccgccaatgccaccacgctgacgcccatcaggatcggcgcgcagctggcattttcagcttccttcgtgcgcggcgcgccaaggaacgtcacgccgtaaactttcgccatacacatcaccgccagcgcgccggtaatcgccaggccaaccgccagcagcggtcctaacagacgaccaacaaacgcgccgctgttgcccagtttgaagaaggactggtaaatcacccactcgccggcaaagccgttcagcggcggcagcgccgccatcgccatcagaccgaccagcatggcgatagaaataaccggcatccgtttaccaataccgcccagtttttcgatgtcgcgatgaccggtacggaaccagatgctgcccgcgcccagtaacagcacgcttttgaacaggctatggttcagcagatgatagagcccgccggtcagacccagcgcgatcagtaccggctgattgagagcaatcccggtaacgcctgcgcccagaccgagcaaaatgatgccgatattttccagcgtgtgataggccagcaggcgctgaatgttatgctccatcagcgcgtacagaccgccgacaaaggcggtgatcatcccaagcaccaacagcgccacgccccaccacagtggcgcattgccgccaagcagagatagcgagagaatgcccagcagcccgattttcatcaccacggtcgagaacagcgcggcggcgggagcgctggcgttggcgtgcgcctgcggcacccaaccgtgtagcgggataatcccggccagcagaccaaaaccgataacgccgagcagccagatatcggagcccagcggcagttgctgagcgcgttgatccagcagccccagatccagcgtgccgtagcgctgccacaccagccagcaggcgattgccagcagcagcgtaccgagacggcccagcgcaaaccacagtttgccctctttgctaccgccggtaaggaacacggcgcagagcgccatgatttcagccatcaccaccatcgtccccagattactggcgaccacagcgcagacggctgccgccatcagcaggttgatcaacagtccgttggcttttacctgtggatggcgatgccagtcgatattgaacaggctgacgaacagaccgcacagccccagcgtaatcagccagatagcattcagcggcgtaatttgcagcatgtgaccggtaaacggcatcacgccgctaaccgtaacggcgctggtcagcgcggtgaaccccgcgcctgccgtacacaggctgccgaccgcgccgccgataccggcaatccagccgctcagcgctttatgaaacgaaaacagaaacgccagaacggcggcggcggcaaaccacgcgacgccgctagtaatcagtgaaagtgaactcattatgcatccccactctgagcctgctgaaacaaggtgagatcgccaaaatcggtattaaacgtcagctcacgtttacgtttgctggcgcgggcgatatccgtgttctccaccaggtgtagcgctttagtcgggcacatccgcacacaggccgggccttgctcgtcaaagctgcacaggtcgcatttcaccgcgatagcgcgcacgcccggcacccagtcgagcaacgtactgacgcgcgcaggcgctggcggcgcgggcggcgctttcggcgtattggcgttcgccggaatatgcagcggacggctgccggaaaactcaatagcgccaaacggacaggcaataccgcacagtttgcagctcacgcacaggctttcattaagctggacagcgccgtcaacgcgattaatcgcgttaaccgggcataccgtggcgcatggcgcatcttcacagtggtgacagagctgcggcgcagattctttttcattcagcatcactttcaggcgcggcattgactgcaggccatgctggcgatgcgtctctgaacaggcggcctcacaggtgtggcagccgatacagagagtggagtcagcaattacaaaacgattcaccaggcattcctcaggtgattgtcatttttgacgaaaacatgccgttgaaatgtcattttcgacacttatcgacacgcccatccccaaaacattcatgacatggcgcaacgccacatcgcgaatcaaagcgggcaacgcctcaggcttatacagccgggctgtgtccctttaccaattggcgcaaattaaccggcgagttggtttctacagcggtatagaggctgtcgtaaacgctggcgattttttccagatagtgctccagcacctgctcgcgatcgcggttgttaacccgttcgtcaaccttgccgtcgatatcgagctgcgcctgtgcaatcaattgcttatcttcgccatctttggtttcaacgtagtactcaatggtgtggctgttaaaaccatccgccaacgcaacgtaaatacgaaagtgctcaaacaggacaaagcaaagatccctttccggcgcgcagctcattgcgtgatgcaggcgcgctttcgagagggtgatcccctgaaccagcgagttgcagtaaatatgccactggtcctgtaggcgacgatgccgttgcgcgatgtaatcggccttttcgcttatttcccaaatagtcatgtcaggttacccgtttaacagagatgcctgcgttaagcattttccatgccaatttttaacttattgtttttaatggaagacgcgcacagttactgccgtttcgacgcggtgacgacatgtcatttcgtcatcgtcgacattaacctgccaggggatacaaatattggcataaatattgctttacaggggcaaccactacgggaggcgatatgcacgaaatcaccctctgccaacgggcactggaattgattgaacaacaggcttcagcatacggtgcaaaacgtgtgacagccgtctggatcaaaattggcgcattttcttgcgtggaaaccagcgctctttccttttgttttgatctggtatgccgcggcacgatagcagaaggttgtaaactgcacctcgaagaacaggaagccgaatgctggtgtgagcattgtcaacaatatgtcacgttgttaacccaccgtgtacgtcgttgtccgcaatgtcatagcgatacgctgcgaattgtggccgatgacggcttacaaattcggcgcatagagattgatgaaactgaagattaatgccggataagatgttcgcgtcgccatccggcagaaagcctgtaacaagaagaagatcaggagtaagcgatgtgtacgacttgcggttgcgctgaaggcaacctttatatagaaggcgatgaacataatccgcactcagcgtttcgtagcgcgccctttgccccagcggctcgcccggcgctgaatattaccggcattaaaacgcctgactttaccccaagtcagaccgcagaaggcgatctgcattacggccacggcgaagccggaacccacgcgcctggtatgagtcagcggcggatgctggaggttgaaatcgacgtgctggacaaaaataatcgtctggctgagcgcaaccgcgcccgtttcgccgcccgccagcaactggtgctcaacctggtgtccagccccgggtccggtaaaaccactctgctgaccgaaacgctgatgaaattgaaagaccgtgtaccgtgcgcggtgattgaaggcgaccagcagacagtgaacgacgccgcccgcatccgcgctaccggcacgcccgccattcaggtcaacaccggtaaaggctgccatcttgacgcgcaaatgatcgccgacgccgcgccgcgcctgccgctggatgaccacggtattctgtttatcgaaaacgtcggaaatcttgtctgcccggccagcttcgatctgggcgaaaagcataaagtcgcagtgctttccgtgaccgaaggtgaagataagccgctgaagtatccccatatgtttgccgcggcgtcgctcatgctgctcaataaagtcgatctgctgccctacctcaattttgacgttgagaagtgcatcgccagcgcgcgtgaagtgaacccggagattgaaattatcctgatttccgccaccagcggcgaaggcatggatcagtggctggcctggctggaggcgcagcgatgtgcataggcgttccgggtcaaatccgcgccattgacggcaatcaggcaaaagttgacgtctgcggcattcagcgcgacgtcgatctcacattagtcggcagttgtgatgaaaacggtcagccgcgtctgggtcagtgggtgctggttcatgtcggattcgccatgagcgtcattaacgaagcggaagcgcgcgacacgctcgacgcgctacaaaatatgtttgatgttgagccggacgtcggcgcactgctgtatggtgaggagagataatgcgttttgttgacgagtaccgtgcgccggaacaggtaatgcagctcattgaacacctgcgtgaacgcgccgcccttcttccttacactgctgaacgaccgctgcgcattatggaagtctgcgggggtcatacccacgcgatttttaaatttggtctcgatcagttactgcccgaaaacgtggagtttattcacggccccggttgtccggtctgcgtgctgccaatgggacgcatcgacagttgcgtggaaatcgccagccatccggaggtgattttctgcacctttggcgatgccatgcgcgtgccggggaaacagggttctctgttgcaggctaaagcgcgcggcgcggatgtgcgtattgtttattctccgatggacgcgctgaagctggcgcaggataacccgacccgcaaagtggtatttttcgggctgggctttgaaaccaccatgccgaccaccgccatcacgctacagcaggcaaaacagcgtgacgtgcgaaacttctactttttctgccagcacattacactgatcccgacgctgcgtagcctactggagcagccggacaacggcattgacgcctttcttgcgccaggccacgtcagcatggtcatcggcaccgaggcgtaccagtttatcgccgccgattttcatcgcccgctggtggtggctggattcgaaccgcttgatctactgcaaggcgtggtcatgctggttgagcagaaaatagcggccctaagccaggttgaaaaccaataccgtcgcgtggtgccggatgccggaaacatgctggcgcagcaggccatcgccgatgtgttctgcgttaatggcgacagcgagtggcgcggcctgggcgtgattgaatcctccggcgtccacctgacgccggagtatcagcgctttgacgccgaagcgcatttccgcccagcgccacagcaggtctatgacgatccgcgcgcccgctgcggcgaagtgctgaccggcagatgcaagccgcatcagtgcccgctatttggtaaaacatgtaatccagagaccgcgttcggcgcgctgatggtctcttccgaaggcgcatgcgccgcctggtatcagtatcgtcagcaggagtgtgaagtttgaacaatatacaactcgcccacggcagcggcggccaggctatgcaacagttgattaatagcctgtttatggaggcctttgccaacccgtggctggcggaacaagaagatcaggcgcgtctggagctggcgcaactgacggcggagggcgaccgtctggcgttttctaccgatagctatgtgatcgatccgctctttttccccggcggcaatatcggcaaactggcgatttgcggtacggcgaacgacgttgcggtgagcggcgcgatcccccgctatctctcctgcggctttatccttgaagaagggctgccgatggagacgttaaaaagcgtggtcaatagcatggcggcgaccgcacgggaagcgggtatcgccattgtaaccggcgacaccaaagttgtgcagcgcggcgcggcggataaattgtttatcaacactgccggcatgggggcgattcccgccgatattcactggggcgcgcaaacgctgagcgttggcgatgtgctgttagtcagcggtacgcttggcgatcacggcgccactatcctcaacctgcgtgagcaactgggactggatggcgagctggcgagcgactgcgcagtattaacgccgcttattcagacgttgcgtcatattgacggagtgaaggcattgcgtgacgccacgcgcggcggcgtgaatgcggtcgcccatgagtttgcggcgtcctgcggttacggtattgaattgtccgaatccgcactgccgctcaaacctgccgtgcgcggcgtctgcgagctgttggggctggatgccctgaactttgccaacgaaggaaaactggtgattgccgttgaacggcaggccgcagatcgggcgttggcggcattacgcgcgcatccgctgggacgtgatgcggcgctgattggcgaagtcgtggaacgcaaaggcgttcgcttagccggactctatggcgtgaagcgaacccttgatttgccacacgccgaaccattacctcgtatatgctagcagcctgttggcagcatactgtaggccggataagacgcatttgcggcgagatccggcattaacgctgcattaacgcctgatggcgctttgcttatcaggcctacggagtgtgtgaccagcgagtttgcggtcagccatccggcaataacttacgacttatacctataattcatttaccgttttcgcaccgttttgcggtattttcctggaaaagcaacatgtcgtatacacccatgagcgatcttggacagcaaggcttgttcgatatcactcgtaccttattgcagcagcccgatttggcgtcgctcagtgaagcgctttcgcaactggtaaagcgttcagcgctcgccgacagcgccggcattgtgctatggcaggcgcagtcgcaacgcgcacaatattatgcgacgcgagaaaatggccgtcctgttgaatatgaagatgaaaccgtactggcgcacggcccggtacgtcgcatcctttctcgccccgatgcattgcactgtaatttccatgagtttaccgaaacctggccgcagcttgccgcgagcggcctctaccctgaatttggtcattactgtctgcttcctttagccgcggagggccgtattttcggcggctgcgaattcatccgtcaggaagatcgcccctggagtgaaaaggaatatgaccgtctgcatacgtttacccaaattgtcggcgtggtcgccgagcaaattcaaaaccgggtaaacaataatgtcgattatgatctgttgtgccgcgaacgcgataacttccgtattctggttgcgattaccaacgccgtcctgtcgcgtctggatattaatgagctggtaagcgaagtcgcaaaagagatccaccactatttcaatatcgacgcgatcagcatcgtgttgcgcagccatcgcaaaaataagctgaatatctactccactcactaccttgatgagcatcatccggcgcacgaacagagcgaagtcgacgaagccggcacgctcacggagcgcgtctttaaaagtaaagagatgctgcttatcaacctcaacgaacgcgatccgcttgccccctacgaacgaatgctgttcgatacctggggcaatcagatccagacgctttgcctgctgccgttgatgtccggcaagacgatgcttggcgtgctcaaactggcccagtgcgaagaaaaagtgtttaccaccgccaacctcaagctgctacgtcagattgccgaacgggtagccattgccgtggataatgcgctggcctatcaggaaatccaccgtctgaaggaacgcctggtcgacgaaaatctggcgctcacggagcagcttaataacgtcgacagcgagtttggcgagatcatcgggcgcagcgaagcgatgtacaacgtgctaaagcaggttgagatggtggcgcagagcgacagtaccgtgctgattctgggcgaaacgggaaccagtaaagagttgattgcccgcgccattcacaacctgagcggacgtagcgggcgcagaatggtaaagatgaactgcgccgcgatgccggcggggctgctggaaagcgatctgtttggtcatgagcgcggcgcgtttaccggcgccagcgcgcagcggattggccgtttcgagctggcggataaaagctcgctgtttctggatgaagtgggcgacatgccgctggagctacagcctaagctgctgcgcgtccttcaggagcaagagtttgaacgtctcggcagcaataaactgatccagaccgacgtgcggctgatcgccgcgactaaccgcgatctgaaaaaaatggtcgccgatcgcgaattccataacgatctctactatcggctgaatgtttttccgattcagcttcctccgttacgcgaacgtccggaagatattccactgctggtcaaagcgtttaccttcaaaatcgcccgccgaatggggcgtaatatcgacagcattcccgccgaaacgctgcgcacgctcagcggtatggaatggccggggaacgttcgcgaactggagaatgtcgtcgagcgcgccgtgctgctgacgcgcggcaatgtgctacaactgtcgctgccggatatgactgccgtaacgcccgatacctcgcctgttgcgactgaaagcgccaaagaaggcgaagatgaatatcagcttattatacgcgtgctgaaagagaccaatggcgtagtggctggaccaaaaggcgcggcgcagcgtctggggcttaaacgaacccccctgctgtcgcgtatgaagcgattgggtattgataaagacgcgttagcgtaacgggttgccggatctgatccggcctggagatgatgcgcgccgtaggcctggcgcttccccttcacttcttgcgctgatatttttccggcaattctggaacggggcgcttatcgtcgataaggtgccgcacggtcaggacaggatgccgccaaagcattcgcggacctgcccaacgcataatctgcttcatctcctcgcgtttagccggctgatagcagtgcaccgggcactgcttacaggcgggtttttcctcgccaaatacgcatttatcaagacgtttttgcgcgtaggcgaacagcgcgtcgtaatgcccctgcaccgctgacgcctgtggacactggctttcatacagcgcgatcatttttttgatcgtcagtttttcacgagcgatacgtttaccaggcatcgtgctctctccgaacattaagatgcatttattttacaccttatccctctttagcactatcactgcatatcgtcgccattacgcaaataagaattattttcatttattcatgccttgtgctatataacatagcaaaggctatattcgatgattaattaaccacattgttgcgagggatactatgacgaatctacatcgtctaaaaacactcctgattgccggtattgtcgcgatactcgcgctatcgccagcctatgcaaaagagaaatttaaagtcatcaccacgtttaccgttattgccgacatggcgaaaaacgtggcgggcgacgcagcggaagtcagctcgattaccaagcccggcgctgaaatccatgagtatcagccaacgcccggcgatattaaacgagcgcagggggcacagcttatcctcgcgaatggtctgaacctggagcgatggttcgcccgcttttatcagcacctttccggtgtaccggaagtcgtcgtctccaccggcgtcaaaccgatgggcattaccgaaggcccgtataacggtaaaccgaacccgcacgcctggatgtcggcagaaaacgcgctgatttatgtcgataacattcgcgacgccctggtgaagtacgatccggataatgcgcagatctataagcaaaatgccgaacgctataaagcgaaaattcgccagatggccgatccgttgcgtgccgagctggaaaaaattcccgccgatcagcgctggctggtcaccagtgaaggcgcgttctcttacctggcgcgcgataacgacatgaaagagctttatctctggccaattaacgccgatcaacaggggacgccaaaacaggtgcgtaaagtgattgataccattaaaaagcaccatattcccgccatctttagcgagagtacggtttccgataaacccgcccgccaggtcgcgcgtgaatccggcgcgcattatggcggcgtactgtatgtcgattctctgagcgccgctgacggccctgtgccaacctatctggatctgctgcgcgtcacgaccgaaaccatcgtcaacggcattaacgacggactgaggagtcaacaatgagtcaatctgcgattaccgttgatcaagtcacggtgacgtatcgcaacggtcataccgccctacgggacgctacttttcaggtgcctggcggttcaatcgccgcgctggtaggcgtaaatggttccggtaagtctacgttatttaaagcgttaatgggctttgtgcatcttgcgcggggcgatatcactatcctgcaacagtcagtcaaccaggcgctgaaaaaaaacctcattgcttatgttccacaatcggaagaagtggactggtcatttccggtactggtagaagatgtggtgatgatgggacgctacggtcatatgggctggctacgccgtcccacagcgcatgatcacgcctgtgttgacgccgcgctggcgcgggtggatatgcaggaatatcgtcacaggcagattggcgagctgtccggcgggcagaaaaaacgtgtgtttcttgccagggccatcgctcaggatggacaggtaatcctgctggatgaaccttttaccggcgtggatgtaaaaaccgaagcgcgaatcatcgatctactgcgggaactgcgcgatgaaggccgcacgatgctggtctcaacgcataatctcggctccgtcaccgaattttgcgactatacggtaatgattaaaggaaccgtactggccagcggccctaccgaaaccacgtttaccgccgcgaatctggaactggcgtttagcggcgttctacgtcatatcgcgctaagcggaggtgaagagcacatcatcaccgatgacgagcgcccctttatttcccgacgcgtggccagcggaggaaaatcgtcatgaactggcttgttgagccgtttggctaccagtatatgctcaacgcgatgtgggtctccgcgatggtgggcggtctttgcgcgtttctctcctgctatttgatgctcaaaggctggtcgctcattggcgatgcgctatctcactctattgtgcctggcgtcgctggcgcctggatgttagggctgcccttctcgctcggcgcgtttctttccggcggactggcggcaggcagtatgctctttcttaaccaacgctcacgcctgaaagaagacgcgattatcgggcttatcttctcctctttttttggcgtcggcctttttatggtgtcgctcaatccgatgtcggtgaatatccagacgattattctcggcaacgtgctggcgatcgcgccagcggatattacgcaactggcgattatcggcgcagtctcgctgacgattctgctgttaaagtggaaagatctgatggtcgtctttttcgatgagacccatgcgcgttctatcgggcttaatccgggtcgactaaaattgttgtttttcactctattgtccgtctctaccgtggcggccctgcaaaccgttggggcgttcctggtgatctgtctcgtcgtcacgccgggcgcgacggcctggttactcaccgaccgttttccacgtctgctcatgattgccgtcgtgattggcagcctgaccagttttctgggcgcatggcttagctactggctggatggcgccactggcggaattattgtcgtcatgcaaaccttactgttcatcacggcctttattttcgccccgaaacacggtctgttagccaaccgtcgacgcgcccgcctgcagaaggagccgacatgttcttagcaacgttactggaaccctttcagtttgattttatggtgaacgcccttatggtttcggtcattgtggcgattccctgcgccttgctgtccgtgtttttagtgttaaaaggctgggcgttaatgggcgacgcaatgagtcatgcggtattccccggggtcgtgctggcatatattgtggggattcccctggcgattggcgctttcattgccggattattttgcgctatcgccaccggttatctggacgataacagccgcatcaaacgtgatacggtgatgggcatcgtcttttccgggatgtttggcgcaggtctggtgctctatgtttctattcaatcggaagtgcatctggatcacatcctgtttggggatatgctgggcgtatcgctgggggatatcgtacaaacgtcggttattgcactgggtattgcgttaatcatagggctgaaatggaaagatctcctgctacacgcttttgacccgcaccaggcgaaagccagcgggctgaatacgacgctactgcattatggcctgctatgtatgattgcgctgactatcgtcgccacgctgaaatcggtgggcattattctgtcgatttcattgcttatcgcccccggcgcaattgccattttgctgacgcgacgctttgcgcgcgcgctgggattagcggtgagtctgtcagttattaccgcttttgcgggcgtctatctgtctttttatcttgatagcgcgccagcgccgaccatcgtggtattatttgccatcgtgtttattgcggtatttatttacgcaacatggcgcgacaggcgtaatgaaatcgtaccagaggcgcaaggttaacagcagcgttcagaaaataaatacgacagttgtagtagaaagccaccctatatctgttgttggtcagtatggtaagcagctatctttaaatttctttacaacaagcgtaaagataagctgctttactccccatgtttttcctgtttcgaaattttttcagagtttggctaacccagcataatgtgattattactcacaagatctgtaatatcccagcaaaaaataaatttataactacacgtaatacaagagagtgattgtcacataaaaaatagtttaattcattcctactgcaatcggtaacgcgcaattatcgtcaggtacagcagggttatgtgcaaaagcagtgcgctgtaaatgcgcgtctagtttcagtccccgaaacagagatagcggtgaagagtccatccccaaacgatacataaccttcttacgataaatactgacggtttttgttcccagaccaaattttttcgccagttcaattgccggatgtccggaggataataatatcagcagcgcatatttcgcctgcgtgacaccgggaggtagattccaccaggcgtattgattgatattaaacaatacctcttccggcgtctcgccggcattaaaagcatacgtagcagccacggttttcttttgtggcctgtggcagaaacgcagccaggcttccggaagacggagcttctctcgctccgagcggatagcgcaggatagttcgtcttttaaaacataatccataacgccaaaatattgcagcacacagcgatcgatataatacaagcgatctgccactaccaaaactttacggttctgcaaccgcgcctgcaacgcatgaaaaagataaacatgctcatgcgggttcaaagctaaaatcagcccggcgtccggcatatcggatagagaatgcaaaagtgcggttaatgagttacacgttttaacgcacttttccggatatttttgcttaaaaatagactgtagggcataacaattagtccagttaataccgtatataattacatttctcatttatttatccttttttgaaaactgaccacagcttcggtaatgatttttcttcctgggcgactactgcgcaagtagataacgccctcttactacaaaggtaataagaccagatacgttattacatgcgcaatgtcgttaccgaaatgaattccttttacaaatctgataatgattaaatttgctgttttactttactgtaatctcttagagtacaacgattgcctgacgccttgtggccatgtatgtctgacaatgaacgctttcggttccctttcattagctacatatcactggtgtagcgatactgaaatatacactacgattaaaaaaatatttggtatctgtaacgcaaacagatagtaacgtttaaaataatttcacaaatcaatggttcattgtacgcataaagctaagcggtgtaatcttaaaatgccgtttaaaaatagcgataaaataagaaggcgtatcatagccacacatcgtcgcgacttgtgaaatatttccagcacccatacgtaataattttatagcctgattcatacgagcatccaagtatattttgctaaaactcacctcttcagcggccagttttcgcttcagacttgatacgctcataaacagctttcctgccacctcagcctgtgaccatttgcgggtgagatcgctgataataatgttataaactttctcttttgttgtaatttttattgctcgctcaaggaaatcaaacccaccgggcttacgtacaaatgccgatataagatacatcaatgagaaatatgaataatcatgatcatcaatactcacattactacaaacccgtggacatgcgacaccatgcaaaatagagtcaaaagtatcactcatccctggcaacaagtccgcatgaaaaaaatactttggtttcgtttttaatgatagctctcgatcattatagtttcttgtactgtaaaaaactttgtagaatttttgcattaagtcataggaaacttccagtgaagaaaaatcaatatgtccttctatttcgctcatactaagcgtgattgtttgatctttttccaataaaaataaacacagcgcagattgttcgatgaactccccaaattcgttttcaattcgcaaactgcctttattaagtttaaacaataagcagtttgcgacataatagtctcttacgtcagctaatccatttattaatggaaatttgttcggttgttgaaggtgattattgctaatggcctcaactgatttattcattgaaggcaataccatattttatcctgtgtgctataaggaactcaaaatcgttatattcttataaacaaataattaaaactcacagagatgatttaaatccgatttttttattattatagccaataattacattccaaagcgcgttcatttcgtcacaaaaagatacccttacaaactttatgcacaattttgtaataaaagcttacaatattaatataatcctttcagaataaaacgcctggcagataccttaataatccatatacatcaataagatagatacactggcatggtgcattttctgcattatttgctgatatatacaccataccttatcacaaatcgccagcaatggggggttcaccagtcaattgcctctttgttttccccgcccgataaaataatctcctgcatccaggaggtcatttgtgactgtgcattcattgtaccaactaataccccgtttaaagcctcatataaatgggtgcccggttcaacttttgctaacatgttttgtagcatagccgtttgctgctcaaaagaaacaaaagccgaatcaccacttttaggatctttgaaggcattcatctcttgataaatgctatctttaagcgtttcagaagaggctgactcaggaagcgccaaaagtcgttggtagaatgcatcataaagatcaacgtcgccgccattgcttaaaggcgcgctatccacattattcagcatagcggccctggcactcaacgaaaccacacccgtcacttcagtatccgctgtcgggaccaaataagaagtcggaatcgtacccggtatcaccttataacctccattttacaatgcttgcgtttttgtcttccattcatcaataagtgcgttaatggcgttatcagaaatcgtccggcagtcttgtggaagttcatcaagatgatgcttaatgacgcctactgctgtttcaacaaattgttcaggtgaaaattctgcgatctgatcgccgcaactcatgataaagcgctgttcctgatgatatttaagattaaaagtgccaggccagttctccataagcaacaccatcagtttttggtgttcttttttcgcattaactggcagtgttaaaaaaagttgcccctccggcttatcgaaatcccttagccactcatccaggacggttaaaagcgtttcgggatggtcgaccgctgctgaaaataactcgcgggcataaatctgtattttttccatccacttccaggccattgtctgattatcagtaagataagcggcgacctgctgtaacgcgtctatcattccctgctcgtaaccttcctgataggcgtacatccgcaaggtctttgcctcttcttccgcctctcgcaaaatacgcttagcccgttggtgcgcctgctgttctaatctttcaatagagaaataacgttccagcgttttacgctttatcagtatcccctcaacaggcgaaagcggggacggaattgggatatttttgagcatattgtaaggccagtagcaaaattgacatttctacagcatcctgcttcaatgcctcctcaataaatggaggaaaaagcaaaggaaaacgctgtgctaaagattcaggtaaaaattcattcagggcatttaactgtgcatacccgacgctaagtaaaaacctgtgattcggcgccttattgcaaacggataaacttgttccctgatgcattgccaaaaatgcttgcgcccaatccggcaggccaagcaaggctccctgccttgccagatcggctctcagtttatggcaaccgagtaaatacgctacttgcggcagtcggcgccactgacgcagccacagctgcgtcagtgagttttgaatacactccttttctccgttcttaagccgccatgtcgccagtattaactcatttgccgccgccctggcggcgggtctgacaatcatttccggcgctatctgcaaccgctgaggatggatatacgataacggatcaaaaatgattctttgccagataatgggtaatggctgcctattcatttgacgatttcgccttatcatcagccgttatgcctttcttattgcgggcataatggtttttgtaataccagacgccagagcctgctgacatcacggataacaaaataatcaacacaatccaactggttgcaaaagaattacgttttactggtgtgccgggagcctgtaattgggcatcagaacgttctgacaacacaacagaaatgttgtcataatccacatcggcaaaactattctttaagaaacgcttgatatcgctgatctgatgcgcaagcggcgaacctcgttcatatacggctaatgccgacagatgaacaggttttggcggacggccattttcaccagcatcaatatcataactaatatggaccctggcggagagcacgccctccatcgtctgtaatgactgttccagtcgctgttcaatagccgaatataacctggccttttcagctcgcggagacgataccagcgaatccgccgggaacatctgcgctatttccacccgtggccggggaggaagctgataagttttaatccagtacaccgcagcggtaaaatcaggctcagcaacggtaatgctatagcccaattttccgctatcaattttattcgcctctatattgtgcatttgcagaacggcaatgacctcattagcctgttcctggtccagtccttttaaaagatccttatccttacagccggcaagggtcattaccagcagaaaggtatatagatatcgacgaatcatgagcgtaatagcgtttcaacagccccgactcctttacgagtaagggtacttaccatagaaacatacaggttataatctgaaatcatctcttgcgaaatagccagctcattaggatccgtcaccagattagggtcctcaatcctgttggtaatcgtctgtttatccacagccgtggcaatcgccgaaccagaaaaagcctggagtagccggtcatccagcgagacaatgtccgtttccataggcctgatattgaccgcctgccctataacggcattctcagggacaatagttgcaatcgacataatccaccttataactgattaacggaagttctgaataatggcagcatcaatatccttaaagacttttaccgtgttcgattgcgcgttacggtacaagttatattccgagagcttactctgatacgccgccagtagcgccggatcggagggttttgctgctaatttatccagcgcctctgttacctgcgtttgtagattatcaacgcccttatcaaattttgctgaaacttcatccagatagcctgaccaagatgttggcataatgacttccttatttgcgttaaattaaagtgggcttgggaaataccaatggcctgggctcattttgatataaccttccgccccgtactgaaatgagcgccccttgagccagtcatcttttaattcgatcgcaaactgcacatagcgtcctccccatgtgcggtaatagctatcgacaaattgacgggctctgagtatttctacatcatcgagcgccccctgaataacaaacgttacgccccccttatgattcctgcgggaataaggtaacgcctgctgttttagccccgcttccgcctggcctgcggcggtaacatcgtccatcaatgtgatgttaaccgaatccgcgtaaggcattagcgctctcagcttttgacttaacacctcgagctctttcttgctcatcgtgtttcgctggcggcttagccagaaaacgggtttacgcggctcatcgaaatgaagccgataataagccagctgcggataataggtatccagccaggtagagatacgcttattttcttcgttttcgttaatcactcgcgcatttttatcataatcgcccctcgctaaaacctgacgagcccacagcgtatctctttcattttgcgcagcgacatagagcattttgtcccgtcctggcaacacctgaaagcgctccttctcctgccccaataacgaatcgagctctgcggcctgccgctgcggcgagttaagtatccataacgtccccaccgtcccaattcccaatataaaaaacccggccagtgctgctacaattccgtttttaaaacgcggctcgttcttttttgcagacgtttctaacttctcaggctgctcgggcacccacggctcgctttccgggcgaatcaggataagcaattcaccgacctgtattggcgtatttaattgcaccgaacgagattcaggatttccttctttcagctcatggagtataatttcggtcgcatccgtatccacctggatttcaaaatttactccgccatggtccagcgggataaaaaagctatcggcaggtatatcagggagttggcctgaagcagtgagcgcatcactctgacctaccacaaagagtgttcggcctgtcagcaatggaaactcacagccgttcagtgagctgttaagtaatcgaactatgtatggccctgggcttgttatcgtcttctcttttgatgtttccatatatactgttagcgatatctgtcgttctcgatagcagcagattaccgcacaggacacagggattcctgatgaaaatagaatgaaaagtgagaaataaaatcaatttattctgtataatgcgtctcaacacatattaaaagaaccatcatccccattggggcttaaactactgtagataaattacccaaatttgggttcttttggtgtaacaatcagaccattgccaacacacgctaataaagagcatttacaactcagattttttcagtaggataccagtaaggaacattaaaataacatcaacaaagggataatatggaaaatgtaacctttgtaagtaatagtcatcagcgtcctgccgcagataacttacagaaattaaaatcacttttgacaaatacccagcagcaaattaaaagtcagactcagcaggttaccatcaaaaatctttatgtaagcagtttcactttagtttgctttcggagcggtaaactgacgattagcaataatcacgatacgatttactgtgacgaacctgggatgttggtgctcaaaaaagagcaggtagttaacgtgacgcttgaagaggtcaatggccacatggatttcgatatactcgagataccgacgcaacgacttggcgctctctatgcacttatcccaaacgagcagcaaaccaaaatggcggtacccacagagaaagcgcagaaaatcttctatacacctgactttcctgccagaagagaggtatttgaacatctgaaaacggcgttctcctgtacgaaggatacaagcaaaggttgcagtaattgtaacaacaaaagttgtattgaaaatgaagagttaattccttattttctgctgttcctgcttactgcttttctccgactccctgagagttatgagatcatccttagctcggctcagataacgttaaagaagcgcgtttacaacattatatcttcgtcacccagtagacagtggaagcttacggatgttgccgatcatatatttatgagtacgtcaacgctcaaacggaaacttgcagaagaaggtaccagctttagcgatatctacttatcggcaagaatgaatcaggcagcaaaacttttacgcataggcaaccataatgttaatgctgtagcattaaaatgtggttatgacagcacgtcctacttcattcaatgtttcaaaaaatattttaaaactacgccatcgacattcataaaaatggcgaaccattaacatttttgtatcagtcactcaagtaaagatttttattaaaattttaataatttaaaattcagaccgtgcattaacacgctatatcaggatgggaggctattcaacatcattgttctgtccggaagacagcttatactgatatctctggtaatttaaagtaaggctgattatataacacgatttttgtgaacttgtcatcgctatgatgactggtaaaccgatattgccttattcacagcgtaagaatccgtccagatgacactatctccttccggctttaaccctatggattaaggccggcattttattcatatttatacatcatccgttccctctgagaactatttgcctgaacggtctacaccgaaacagtcacgcttgttagctttctgccaggcatacatcttctcttcatcctgatatcgatataatgcctgggggccagcttgaggatgatactgctcataaacccctgcctttttgacgctatagctgaaggagtaaagaaaagacgatatcattattttgcaaaaaaatataaaaataagcgcaccattaaaaacagtcttgcatttatattttggcacctaagacaaattacactcttaaactttcaacgaatggtcatttagtggaaatcttcgagaaaaatggttctgatggtgtaattatcagaccattaaccatgaagatataataagcagcatttacacccccaaaaaatgcagtaagatagctacaaaactaatctctattgcaatgagaccaagttaaatatgtaaatatttagatgcccggcgctgactctcggcaccaggatatacgacagcgtccattcgacaatcacggttagttataacaatatcattaccaacatgtcagttatttaaagcacaggcataagctaaataatcaaatgttaaaaacatataaacccgagcccgtacaatatgacattaagctcataataaaagctcaacctgaccgttagtactagcagcagaattactgaaacagtagattctatcctaacgacttgtattagctattataacttttcaccctgtaagagaatacactattatcatgccacattttaatcctgttcctgtatcgaataaaaaattcgtctttgatgatttcatactcaacatggacggctccctgctacgctcagaaaagaaagtcaatattccgccaaaagaatatgccgttctggtcatcctgctcgaagccgccggcaagattgtgagtaaaaacaccttattggaccaagtatggggcgacgcggaagttaacgaagaatctcttacccgctgtatctatgccttacgacgtattctgtcggaagataaagagcatcgttacattgaaacactgtacggacagggttatcggtttaatcgtccggtcgtagtggtgtctccgccagcgccgcaacctacgactcatacattggcgatacttccttttcagatgcaggatcaggttcaatccgagagtctgcattactctatcgtgaagggattatcgcagtatgcgccctttggcctgagcgtgctgccggtgaccattacgaagaactgccgcagtgttaaggatattcttgagctcatggatcaattacgccccgattattatatctccgggcagatgatacccgatggtaatgataatattgtacagatcgagatagttcgggttaaaggttatcacctgctgcaccaggaaagcattaagttgatagaacaccaacccgcttctctcttgcaaaacaaaattgcgaatcttttgctcagatgtattcccggacttcgctgggacacaaagcaaattagcgagctaaattcgattgacagtaccatggtctacttacgcggtaagcatgagttaaatcaatacaccccctatagcttacagcaagcgcttaaattgctgactcaatgcgttaatatgtcgccaaacagcattgcgccttactgtgcgctggcagaatgctacctcagcatggcgcaaatggggatttttgataaacaaaacgcaatgatcaaagctaaagaacatgcgattaaggcgacagagctggaccacaataatccacaagctttaggattactggggctaattaatacgattcactcagaatacatcgtcgggagtttgctattcaaacaagctaacttactttcgcccatttctgcagatattaaatattattatggctggaatcttttcatggctggtcagttggaggaggccttacaaacgattaacgagtgtttaaaattggacccaacgcgcgcagccgcagggatcactaagctgtggattacctattatcataccggtattgatgatgctatacgtttaggcgatgaattacgctcacaacacctgcaggataatccaatattattaagtatgcaggttatgtttctttcgcttaaaggtaaacatgaactggcacgaaaattaactaaagaaatatccacgcaggaaataacaggacttattgctgttaatcttctttacgctgaatattgtcagaatagtgagcgtgccttaccgacgataagagaatttctggaaagtgaacagcgtatagataataatccgggattattaccgttagtgctggttgcccacggcgaagctattgccgagaaaatgtggaataaatttaaaaacgaagacaatatttggttcaaaagatggaaacaggatccccgcttgattaaattacggtaaaatctgagagaggagatatgcattatttttttatcatcgtaatctggttgcttagcataaatacggcatgggctgattgctggcttcaggctgaaaaaatgttcaatattgaatccgaactactttacgctatcgcccagcaggaatcggcgatgaaacctggcgccattggtcataaccgagatggttcaaccgatcttggcctgatgcaaattaacagcttccatatgaaaaggctgaaaaaaatggggattagtgaaaaacagttgttacaggatccctgcatttctgtcattgtgggcgcatccattttatcagatatgatgaaaatctacggttttagctgggaggccgttggcgcttataatgccgggacgtcgccgaaacgatcggatataaggaaacgttatgctaaaaaaatttgggagaattacagaaaattaaaagagatgtcagcagaagagaaaaacaaaagactttctatcgcggtaaacaaataattatacaggaatagcttactttcagataattctaaaagtaagctatgtttttatcagcttgccgtcgtcataagcaactgggcttgcattgcttttagttgtacaaactgtgaggcgtcttccagcattctattgttccgtgaattccggaaatctgcacgtacctgctccagattactatgaggattatccttaagtacaagagccgccgccatcgttccggttcttcccactccgcccagacaatgaatcatcggtaaatgcttatctgatgaactacgccccggcgcgccattttggttactatttttcaccctatccgccaggtattctaactgatcagtagacggtaacggctggtgatctggccaatttttcacatgcaataccgggattgtataccgcttttccccgcaggacagttgcatattgtattggtctatcgctcctccctgactggctgagctcactttttggctgttggtatgcacctcgccaaaggtgtagctccctctgaaataggctggtaattgttttgcctgcatctgatcttccgacgttaacaccaccaggcacgaacattctttttcaagaagcattttcatatgcgcttccagcgcatccggcgtattttttgggcacgaaccggctaatgccacaggcttaccgtcaaaagttaacgtattcactggcacaggcattccatcgctcagtttcacctgggtttgctgattaatgggaatgctgctgaccgcaaaccgtgccaggcccagtgtcggtccgctcatcgtctgtggcattgacgcaccggcttttattttctcaagttcagctgtaacgtttttcagttctttagcaataacgtgaattttttttaccgcttgggttaattcatgagtagaggctttatcaatccacctctcaacctctcccccacaggttccccattgtgagaacctgtctgctcctatctgaatattttttaacgttgtaacataatcattaagttgtttagcctctggaattttatttaaactctgtaaattcgtcattaatgaacgcagcgggccgttacctgaagccatctcctggaagttttctcgcaggctatttccatccatttgttccagttgcggtattgttctcttaagtccctttagcgcgatatcgagtaaaggttgcttactttctgcaccaacatcgttattttgttctgtcacttttgtatcgccgccttttatgactaaagcggcattcatgacaccaacattatccttgttcttaataagatttataaaccctccgtcagcaccttttacacactccgtgatctgcactactaaacgttgggtaaggggtttgttcatatttatactggacatgtacaaagcattattgaccgctttttccccatatttttccgttaatgcctggagaaatgtctgtaaaatcttttggttctgtactctgatattttccgtgtgtttttgcaccacttcagtgtttttaaataagggcatttttccaagccaggttaatacttttgacgaaaatttttcaggcgcaacatatgccttatcagtattttccttagcaatatatagccgggtatcactcgacacgccagattttgaaaatgaagacaatgttaaattattcaacttcctctcatcataccttagcatattcctgtagtatgtttttgagcgcttcctgcttattcacaaatgactcaagctgcgatatgatatgataaatatttgtcagatcggtaattgcatgtataaacaacaacgtctctgcggcatcaatatacgctaacgtaccttcattattcgcagccagttcaccattaatcaccataatctgccgccagatagaatcgccacaaacaggcgatagcggtataatcataccgttcaataaccagatatcatctttagcttcaatagacgtaaaaatatcgctatcgagtagtaataagcactgattgttgtcatcaaaagtgagcggtaaacccaatttctcaccaatattagcgataatatcctggtgtgcttgcaatttactttcctctttaattatatcttttacaagattgcttcttcaaatttaatctggttacacaatgtcttgatattttttcgcgcccatcgccgagcgcaatatttctctcctttaatccagtagaatagccattcactacgcatcggaacacaaatcagcagttccttcggatcattttcaacatgacgtaacttgcctttaataacaaaacgcgaactgtcagcaatatcatcatatattgcagccatgcctgaaccgggtactacatgtgtgatgattttcataacaattaatcttgttcaattgttgtcgagcgagagaaaaatactacaccctggactcaagactttttttaacaacacggcatatatccgcaaaggtcgtcatatcaggaagatcgttttcattacaactaatgtcaaactcctcactaagaccaaatacaatatcaattaaatccaatgagtcagcgtaaagatcctcaaccagatgggtctgaccattgatactatcaacatcaacggcaatacaggaggtgatcacttttttgactcttgcttcaatatccatattcatcgcatctttcccagttaattaacgctgcatgtgcaagccatcaacggtagtaataacccgatccacaccaggtttattcaggtatgactcgtaagccgggccagctcgccagctaccgtctccgataaggccgtccagcacattacttaacacatagtcagtttcccctttttgcctggtcaaccccgcctctctggcaaactgcaatgcaatctcagccagtttttctttttgtggatgatgagtaatgacctctttgagcgtctccattttcgctttcaattctgggtgcttgtcaatatcgctacattgcgctttcaacgctgcactctttatcgtgtcattgggtaatatttccccacgcaagccgtcaaacgctctgcgtacaggaaacggtgtagaggcatccggctccagggctttacgtatcacacccaaaaacgcctcacgggcgttgaaatgtattgaatgcatattcgtaacgctcggtactgttgagaggaaactattttgcttaaacttcaaaccagaaaatgggccagtcttatctgtctggctattatcattatcggtcgtaccggctttattacctgtaattaccgtcgagtctgattgtaaggtatcgattttaacattctcgacgccagccagttgactggcaagcggcttcacattcacaatctctgccgtctggctttgctgtttattatcatcaacgccgtgcaccgtggcctgtaacggcttgccgataatgctcttgctggttacgccatcgacttcatcaaaagaggttgtttcacccgtagtgcccttttctgacgtgaccacctttccatctttactttcggatgaagagttggtcacagcctctgccgtcgcatgagccgtgacgtcaattttacccgcgatgccatggtcaattgtccctgtgctggcgctgtgtgcggtctccgtttgatgcgtagtcgaatccacacgcgaatgactatgacttacgttgctgctgttagtcgaatggtgtgactcgccatggcgttggctgttatcaataaatgttcggctattatcaatcgtcttccggctattatcatggttgctattatcgatatggcgctggctattatcgacatggcttcggctattgttaatatgcttactgttatccacgctatggttactgctatcaatattaatattgatattaatacccgtaggttctgcttttttcccaccatcaggtactggtccagccgcaggttccggaattttagggtcaggcagtttatctgcaggaatttgtgcaaaaacattacgtagcagcaggggtatcaacgtttgcatttcaaggtgccgggcttcccgtcctacgctggtaccctgctcttgcgttaatttttggtggcacatatcaagcgcctcaaccgccttcgccgccgctttgtcaacaagctgcgtaagactgctgcgggttaacggatctaacgtacagccaaagttatgttcaatgcagctggcaatatagggcatcacctcctgcataacaagattcgtcgataatttacttaattcaccgccagtgttatttttgatgatatctaacagctgcttttccaggttttccagcttcgcttccgctttctttgtttctggcagccatggcccaaaagctgacttttctttcaggccatcttttatgatttgcgcggtatactctgcccccaccttcatcagtagcgtcttcgcctcaggagaatcactggtggcgttgagcgctgaacgaaagaggccggcaaactccattatcgctttcttaccggcgacattatttgaattggtaaaaacttcttttaacgcctcggcgtctttcccgcatttaaacaacgcatccagactcgcctgtttgatcagcgcgggaaaatcttccagttgctggcctttaatttcccctgacagcgttgctgtggcactttctctgaccgcggaaagattcgccgcaagattcgtggcctgcgttttgatctcggtctgcatacctggcattatgacggggggctgagttcttacacttgtaaccattattaatatcctcttctgttatccttgcaggaagcttttggcggtttccaggctgctacttatcgtactgctcagcacttttaccaggttgtcgtacaatgaattggcattgctatatttttgcgtcagcgtctgtaatgtggttttcagattttcttcctgtgctttaaaacccgactgccaggcttgatatttggcgttatccagttcaagggctgaacccgatcctattccattaagatcgctaaccattttgctcagtggccccgtatccaccagtacgacataaccagaaccagacgcctttagacagctgtccggtaaattcaattctttaatccactgctcagcttccgctttcgttgctgttgtcattccgctgccagtttgcgagggaaataaaatcgtatttttatttatttgagtgtatttattaattaaactacttatttcacttttaagtgagtcaacatttagcttaatggtatttccatccttaccaggcgataaccagcctcccattttggaaagaatatcactgaaggcctgataaaaatcggtatagactgcgacaacgttttcataaacgcccaggtagctgtcacctatcgccgatatattttgggaaaccatatcccaaatctcagcatcagaaatggttgttctcggctgcgccataggcgaagcgctaaataaggccgacgtcggcgcagaaaacgtgctccgcaggttctcattttgttctgcggataatgacacgccggacttcgccagcgcattcaggctgctggtcaactgttggcgcgccagcgtgcgctcgtcattattctcttcagaaatcggtggcgttgactgcagcgtctgctgtgcctgctggattttagtagccgcctgcgataatgaaatgatatctgtgccgcgatgttctgtggtagacggtaccacggcaatctcggcgtgctcgctcgccgaaggagtctgcggccgttcggcaacgatccccggatgaggagaagcggaataattttgaatattaagcataatatccccagttcgccatcaggagggcgattaaatccccccctgatggcgtatagttgatctgtcagattaagcgcgaatattgcctgcgatagcagcgagtgcggatgctttcgactggttaatgctctccattgttttcagcatttcctgaatcaggctggtcgatttacgtgaactttcacgggcttcgtccgatgcggtgctggcaacccggttattcacctggctaatttgctgctcggaacgttcctgagtagcggcgtactgcctggacgcccctgcaataccaccgaccgtgactgagttcttcataatcagatcgcccgtcatctgcatcttgcgcgcatcgattcgggtcatatccatggtattctgctcaagacgaatatcggattcgacagactcaagacgtttcgacagaatagcctgatgttcaggggagatttgtttattactgtttttaatacccagactttccgtggcgctggttccggcattagatttaagcgtcgcatcattaagatttttcgtcgcatcggtaccggttttcttcatatttaacgatttcagagaatcgacgccttcagcaccaagtttgacgctattctgcccgttcagcacgtttttaatactgtggctttcagtggtcagtttatcgatcttcgcggcattatgtttaagcgcgcctctttcattctgcagccccttatattccagtttggcgcccacgccagtgatccccaactgaagcgcgctctgggaaatactaccggacaacgcattcatcccttcgcgcatcatggagcttgccgtcgttttagctgcatcaaaactgactaatgacaacttaccagacagtttgctatcagcctggttcaacgtcagcattaacgtattcgcggcagccaacagcgcaacggcactggaagacattccgctaatatcaaaaaactttccgacttctgcctgctgctcgcgtaactgggtttgcacaacctcattcgctttagtcgtgacattatttgccagggcattcaaatcctgattcatgtcggtattttgaatactggcttttaaaaaggacgtgatcgttccgggggtttgcgttaatacccctggcgcaggcgcgctcagtgtaggactcaaccccaggtcactgactttactgctgctaataccaatactattcagaatatctttagcgctaacggattgcgaagctgtctgtgaactattctcaacagaatgattatttaaataagcggcgggatttattcccacattactaattaacatatttttctccctttattttggcagtttttatgcgcgactctggcgcagaataaaacgcgaagcatccgcattttgctgtaccgcagaagacatggctttttgcagttccgccgttaccttctggttttcaccaaatatttctacggattgtttaagccactgctgaatctgatccatggcaaaacgggcgagcataaaatcagcaagcgcctcgctggcatttttaataaataccccctcggcaaccccaccggctgactgggctgcggtattcgtgacttccatgcccaacgccactttatttagggtattacctaccagctctttacttaaggcattcgtttgcaggcccatcttgctacccacattacccaggccgctagtaatacgttgcatcccctgggtaaagagtttgctgccgttttgtgccaactgtttcagcacgttaggcaccaacttcttaatcgtttcgcccatcattttgctcagcgcgttacccagtttcgccgccgcgcctttcccgacaactgcgaccaccacaatgaccgctaccatggcaatagcggcgacaatcgcaccaacaatgctgcctgccatctctgccgttttcttatcgacgcctaatccttccagcgctttggtaatcgccttgccaatcagctccattaacggcttcagcacatgctccataatcgggtttagcgcctgctgaataaacgacacccccgtcgccgccttcacaatttcatcggccaccattaccgcaagtcccaccgcagccagcgccagactcgccccaccggtaaaaacagcggccacaacgctgacaatggttagcagcgcgccgaggactttcccgatacatcccataatgcggttcgtttcctcggctttgcgcgtctcttcctggaattcagccgatttcttttccatctccgcctgacgcccttcctgcaaggcgttgaaaagcgcaagatcgttttgcaggctttcttccgtatttttgcccacaatctcaataaacatggccatgagcatagtgaggcgggcgacatttgacagattatcctgctcaccctgggaaacctgattctgagaggcggcattagccgttccctggaatttggtcagaatgttatccgctttctcggctttcgctttggcgtctgtgcctgctttaaccgtcgcatccgtggccttatctaaggcctctttcgcctctgtcgcttcttttccggcctgttctaccgcggcttcagcttgtgcatagccggggtcagctgggtccagcgattgcaatttattttgcgcctgcgtcagttttttggccgcagcgtcataaacactcttggcggtatccgtctttttgatgctggcttcatagagatccgtcgcctcctgagcctctcccagagccgtctggaattctttcgatacctgaatccccatctctttttgtgactcaatcatcgcctgccataccgccagacgagactccagttgagacagcgaaacatcgcccagtagtgtcattaacttgccaagcagtaatgtcaattgcccttcgctggagagtttttcccgggcggcgtccgtaggcggctttagacccaccgtattaatagcgctctcgccggactttgttccggctttaaggtcgcccgctttcgttgccaccacatctttaaaagctttatccgccgcttttaaaaagtccgtgttcttacgaacgccttcaaaagccgcctcagcgaggcgcggattttgggtatatccgctacggctaatgctacttgcgtcatttaccataattattccttttcttgttcactgtgctgctctgtctccgccgtttttagcgcctccagatagaccaacgcttttgcccgcagagactcatcttcagtacgttcattgacaagttcaaaacactgtctggcttttgccgccttacgcattaataattgacactgcccggtaaaaaaaacggggcgataatcatttttaagtaacgtaaacgctactgcataaaggtcacatgctttctgaaattgttttttcagttggcataccgccgccagtcccatggtgtaatcgggattgtaaaaatcataaatgcataagaaacgaaagaatgtctcagcttcatccagtcgtccctggttataaaactcataagcatgagcatataaaccgtccatcatatcttgagggatcccgtgaacgtcttttagcgtggcgccttcactaacggcatcccaaatcatttccgcaacacgttcttcgctgacattattttgataatccattacttactcctgttatctgtcaccgactttgtagaacttaacgactgcgtttatctgatgcagttattaaaccccgacggtggttagtgaacattcaaaaaactcccaatgaatacatcgctactgctttacgcggctcaatgccgtacctcgttttcttgtggctgaataacgtctttgcccgcgttttctacctcttccagccaaaccagaagacgtaaaacttcatcaatttcttccagactcaccagatcataacggcgatgggttttgaaaagactgcgcgccagtttgatatcgacgatcacaggtacgccaaccttctccgcataggcgcggacggccagtgcgcgctgattcgtttcatacaccgagatcatcggaatcggcatcaattcgggtttaaaataaatcccgatcgtaatatgcgtggggttggcaacaatcaggcgtgagttttcaatatcggatttcacctgttcagacagaatttccatatgaacttcacgtcttttagatttaacctctgggttcccttcctgctccttcatttcacgcttcacttcttccttatccattttcatatctttcatggtcaggaaatattccgcaatagcatccaataataagacaatcaatgcgcaagcaaggcaagttaataccaatgcgaggagaagttcacgccaaatgacggcaatatccacaacattgccatttaactgagaaaagatttcaaccttatatttcttccagcaaatgatggcggccaccacaaaggatgagagatacagtagggttttgaccgtatctttaaccgtgcgcatactaaaaagttttttcgccccttctaccgggtttaacgccgataaattaggttttaatgcttctgtcgccagcacgaaaccggcctgtaataacgccggtaatgcggaacacactaaacagagcagcataaatggaatcagatattttaatcctatcccaaaaacggccaaactgtaatcagccatgctctgatcaaaattatccgcaataatgatcttaattatccccataaactcattaaatgagccatacgacaccagataggcaattcctcccagcgtcagacaggcgataatgagatctttacttttaaatgactggccttttttagcggagtcttccagccgttttttagtcggtttttctgttttattcgaggacatgcgtcgcccctcgctcgtaaaaccaactgcttaaccctgtggcctggaaagagagtcgcggtacattgtccggtagtaccggagagaaataaagcagcataattaaaacggcaatgccgctttttaccgtcagtgaaatcgcaaaagcgttcatttgcggagcaaagcgcgacaataaacccaggaatacttctgacagcaacagcactaataccaccggactggccagaaccaaggcgttttgagccacctgattaataaacgttaatagcggcggtaatgaaggcgtgcactcgttcatcggatcgcatagctgatagcttttatttaacacgtcaaccatcgtgaccagaccgccgttttgtaaataaacgacagcggcaaacatattcaggaaattagccatttccgaggtatcaataccgtttgccggatcgatactgctacttagcgttgcccctcgctggttatcgataatacaacccagcgcatgcataacccaaaaaggccatgacagcagacagcccagcatgacgcctaccgccgcttcttgcagaactaacgggatcatcgccaccgataaaaacggcggcgcctcgttcaatgcatgcggccatactcccaatgccaccaggatgataatggcgtttctcggcgcgccgcttaataccccgctattcaaaaacggcaggaagaaaaaaatcggcgctacgcgagcaaaccctagtgccgcagacgcaaccaggtgatgaatttcaaagtacaacgcgtaaagcattttttaccccttagccaacgccaggaatatcacctgacgcccgtaagagagtaaaacttcgccataccagccagacagtaaaaacaagcataaacacacgccaagtaatttaatgccaaaaggcagcgtctgttcctgtaattgcgttaccgtctggaataaccctaccaggaggccgataatcgttgcgacaatcgtcggccaccctgacaggatcaaaacaagatagagcgccttattacctgcaaacactaaatcatccatttaactatcccgtctcgtaatgatgtcatgttgcaatgtccatatactgtaatatcaatcccttagacagtaaggtccagccatcaagcgcgacaaaaagcaccagcttaataggtgtagatatcgtcaccggactcatcatcatcatccccagcgccagtagcacgctggataccaccaggtcgacgacaacaaagggcaaatagagataaaaaccaattttaaacgcgctttttatttcgctcagcgcataagcaggtaataacgcaaatattgatggtttttcaatttcatctttgtcacgctttaccgtctcggtctcttctccatactgacgcttcagttgcgcgttttcaaaaaactgaactaactcgcgatctgaatatttgatcagataatcgcgataaccatccagaccttcatcaacgtgtttacttaatgacgaaatatcattaaaggtgacatcttcgtcctcaaaatagacgtaggcatcatgcattattggccacataacaaacatagaaagcagcaatgcgacgctgttaagcgtcatatttgaaggtatctgctgcaatcccagggcgttacgcaccatgacaaatacaatagaaaatttaacgaaacaggttcctgacgcaataataaatggcaacagggtggaaaatgccagtaaggcaattaatgagatatcattccccattaccagactcgctcagccattcatggatctcaacgcctaaggtgtcattcatctgtaccagttcgccattaccaagcaaaacaccattcgccataatttcaacgttaagttcaacattggtcggcagtgataatagctgttgctgccccatggcttcgagttcggcgagggtaacgttcttacgatacaaaacaaattccagtttgacgggcaattgattcaagccaggcagagtttctgcagtttcagttgtattattttcttcttcgatatgttgaatatctaacgtttccacaataattcccccttcaacacggttgaaatgacctaactttttcgcgtagcaataaacttccgcacgggaagtacgaatcaggagtacatctccgatcccgattcggcccagcaaagaacgctgcgtatcactgctaccgattacaaagcgcaacggccaacgcagcattttcggcctgccgcccccgactgcaggcagttcaggaagatgctcaaaccacaggccgccccgatcgctcataatgtgcaacaatttcccttccggcagcgcgcttcccggtacggggttctctacgcataaacgccgacaggacaaatgcggcacgggcaactcaaacggtcgctctgttgcagcaagccagggaacgaccaggtgctcagcaccggcagaaaccgccgcccccgccagagcgggagagacatgctcaagccagcccccaggtttaatccaggccgaccaccgtttttctgcatcgctcaaccgaacccacattccctgtcgcgtcggatattccagcgtcgcttcccggccatggcgctggcattctgtcgcggtttgcgccaatagccattcgcgacgatcaatctgtctcacacgcaatgacatcaggcgtcatcctcctcgccagattgctgtctgtgctgttgctgctgcggattttgttgatcgtctcgcgtcaggtgccagcgctggggattaccgttttgccattgatcatgcaaacgatgttcaacctgcgtatttgacggtattaacgaaaactcccctgcttgccgcgcctgaatattgacggaatagtcatttccccagcgctgaaaacggtaagtcagcgagctatcctctcctttcacgccatcggcagtgggaaaaatagtcatcatcggctttgattgcgccgctaaaggcattttttcatcgccgccggttaattggctaagatcggcgatagtggttggttgcagcggaagctgagaaacatctttaacctttttatgatctttatcgtcaggcttaccggtattggctgcggccattcgggcaggtgcgacatcccgcgccagcggcgcgccctctttacgaacgccttcgcccgcgatggctttattatccccaggcaatgccttgatattatcgtcagagattcccgtggcattatcggttacttcactaacggattccacggcttttaaatcagcagataattttttaccgcttacgctttctaacggcctatttttaggcgatagcaacgctgcggatttatctactttggcctccgcagaaatcaaaccgacagatttttcagcagtgactttcaacagtttttcagcaatcctgagttcgccttttccgttatgatgcagaccagaaacgttgccattgtgatgttctgatttcgctggcgcgcaatgtcgccatgccgccagtaataccggtaaagccgtttctttatgcattacgaaagcatcgccatagtcgcgatcttttttatcaccggaatattctgtcttatgtttttccaccgttttttttaatgcttctgataaaccgccaacctcatcctgctgcggcagtaaaatgttcccggatgaactgacagctgacacatcgcccattaaattatctcctctgactcggcctcttcctgctgtatctctcgctggatatagtgtcttttctgacgaattatccagcgttgatagttcccttctttgcgcaaccaatatttactttttttctgaaactcttcccttttcttttccagctcgctccgtttttcctgaatttgtataatctggagttctaaatcttttatctgccggcgaacaatagactgcttacgtaataacgtataaatttcctcacgactgagctgtctgttttctgcacgcagcgtatctaataacaatttcagacccgctatttgttcaaggatcgcctcctcctcggcctgcagcccgcggtcctcatcctgatagcgaagtaatattgactcacactgtgaatgaaataccgtacagcgccgctgtaaaactttaattctggtcagcgaatgcattcataccgctcaacgtgtcatcaaaggatgaatattgcgctaccggctggcataaccaggctttcaggctatcccgcatctgcatcgcccgatcgttatcgatattttcgccaggacgatattctcccaagtcaatgaaaagctggagctcttccagacgcgtcattaatttacgcacggcagatgcctgttcagcatgtgtcggcgtcgtgacttgtccaaaaacgcggcttacgcttttcagtacatcgattgccgggtaatgtccctgcccggccagctttctgctcagatacaggtgaccgtcaaggatagagcgaatttcatccgccatcgggtccgcctcttcctcgctttccagcagtaccgtataaaaggcagtaatgcttccctcgctggtcgccccggggcgttccagcaagcggggcaaattatcgaatacggaggcgggataacctcgacgggccggacgctctcccgacgccagtgccacatctcgcaaagcacgcgcataacgggtcatggaatcgataaaaagcacgacccgttttccctggtcgcgaaaatattccgctacggttgtcgccagttgcgccgcattgcagcgatcgaccgaggggaaatcggaagtggcaaaaaccagcacgcatttttctttcttatgcgaagcgcgcaacatatccacgaattcagtgacctcacggcctcgttcaccgataagaccgataacaaagacatccgcctccgtttgctcgatcagcatatgcatcagcatggtcttaccgcatcctgcggaggcaaaaatgcccattcgctggcctacgccacaggtcaataacccgtcaatcgcgcgcacaccggtaatcagcggttcacggacgccaacgcgcgaagcgtaagacggcggtgcgacatcaataacgcgttcttcgctaatcggcgccacttcaggggtaaaacgctcaacgattttccctgtcggatccaacaccgcgcctaatactgagtatcccacccacgccgataacgcacgtccagtgggataaagcacgacatcgcggctcagcccctgggcattgccgataaggctcagcacggtgcgttcccgctgtaagccaaccacctgcgcacgtgcaacaacctgtttttggtgccagccacggcgtatttcacacagttcgccaatggccacatcgcgcaattccgcctcaataattgggccggttattttttgtgggtaggccagatattgcagtaaacgaggtgttttcatctcattagcgaccgactaaaaacttccagatagttgtaaaacccattcaaggcagtagagaacttttcaccgtcagataaaaaatccggatgcactaaggctttaagcgttagctccccattctgctcccccagtagtaattgcccgccgcgggcaaaatggcatccttccattatggtcattaagatttcataagcccgctgttgtaataccaccatgctgtcagcacccaattgcgcccagatccatacatcatcgtccttgacgctgatacagatacttggcaatgcaaataaatccagaacaattgttgaatggctatctattcctccaattaatgaaggatcgcaaccacttacttccagtgcggaacgaactaattcagcgatatccaaatgttgcatagatcttttccttaattaagcccttatattgtttttataacattcactgacttgctatctgctatctcaccgaaagataaaacctccagatccggaaaacgaccttcaatcattttcttaataaatcgacggacatcgacagacgtaaggaggacaagatctttatgtgcaatcaataaatcatccaacttaagtgtaatgagatccatcaaattagcggaggcttccgggtcaaggctgaggaaggtactgccagaggtctgacggatccctttgcgaataacatcctcaacttcagcagataccattactgctcgtaattcgccgccattggcgaatttatgacaaatataacgcgccattgctccacgaatatgctccacaaggttaatgacatctttttctcttggcgcccacaatgcgagcgcttccataattaatttcatattacgcacggaaacacgttcgcttaacaaacgctgcaaaacttcagatatacgttgtaccgtggcatgtctgagcacttctttaagtaaatcaggaaatttcgcttccagttggtccagcatatgttttgtttcctgaataccgaaatattcattgacgttgcgcgccagcgtcaccgccagacagtggtaaagctcatcaagcgcgttccgcaacacatagccaagctcccggagtttctccccctcttcatgcgttacccagaaatactgactgctaccttgctgatggattgttggattaatgccaaaggaaacaacttcatcggaataatttaccactcgcatcaaatcaaaatagaccgtaaattgttcaacacggatctcattaatcaacaatacgatgctgttatcgtccaggccctcgccatcgcgtaacaatacttccggcaggcgcacgccataatcaataaagaactgactacgtaggcgctccgcaagttgagctttttccagatcttcacgccggctcttcggcacaagtaatatcaacggtacagtctctgtagagactttatcgagatcgccaatcagtcctaacgacgacccttctttttcctcaatactgagcggctgctcgcctttgctggttttaggtttggcggcgctacgttttgcttcacggaatttaaaatagaagagtacgcttaaaaccaccgataaaataacaaataccggcagcgggaatcccggcagagttcccattgaaatggtcaaaatagccgtaacaaccaatacaaatgggttgttcaacagctgcgtcatgatattccgccccatattatcgctatcgccatttacgcgagtcacgataaaaccggcactaatcgcaatcaacaatgcggggatctgggcgacaagaccatcaccaatggtcagcatggtataagtagacagagcggaggacaaatccataccatggcgggtcatccccaccgaaataccgccaataaagttcacaaagatgataatgatgccggcaatagcgtcacctttgataaacttcatcgcaccgtcaaaggaaccgtaaagctggctttccctttccagtacgcttcgccgttcgcgcgcagcatccgcatcaataataccggccttcaaatcggcatcaatactcatctgtttaccgggcataccatccagagaaaatcgggccgcgacttccgcgacgcgttctgaacctttggtaataacgataaactggaccacggtgacaatagagaagacaacaaaacccaccgccaggctatcgccaataacgaattgcccgaacgtggcgataatttcaccggcatcggcttcaatcaagataagacggctggtactgatcgataatgccagacgaaagagcgtggtaattaacagtaccgcaggaaacgttgaaaaactgaggattctgtcaatgtagaacgaccccataaacaccaatatcgccagtacgatattcagtgcgatcaggaaatcaaccagataggtaggtaatggaatgacgaacatagaaatgatcatcaccattagtaccagaatcagtaattcaggtcgtaaacgagcactgttaagtagagaaagcagcactataggtatcctgttaatattaaattaagacagcttttcaatagtacgacgctgttctgccatttcatgcttgtaggcaatatcggtcatactacgtaacgccattaacaattcttcctgccaatattcttcataaaagagtgaagagggtatggctttacatacttgataaaatatctgcaaaaaggatgcatgttctttatgactaagcaataacgcattcaaacctataatatcggctaacagcgaatccacttcatgtggctgttgcaatagcgaaagcatcagtagtagccacgacgactcctccgcattaaacgctttggtaaacgaatacgacaacaatgtactcacaaacagtaggtcagcggagcgcaacattttaagttgcgtcaggcgtcgtaaaagctggccaaactccaggcgcgaacagctggcgtcattcgcgtcaatatcggttaatagcgaaccctcgataaaatccagtaccaccagtcgacgttgatagccataactggctatccagtcagagtaaatctccacttcatgtgattcactctggataaattgccgatagctggcgcgcaataagcctggttttaacgataatgttttcccaaaaagccgggccttcaacgcacaattaatccctgccttgagggtcttcggatcggtttgctcttcaacgtgcttaagtaacgactccagctttttccgcacgatctcttccaggtctttacgacgaagcaattcgcgtaacacaaggactaaatcactggggtcaggaaataagctacgcgcctgacgtaaaaaatcttctaacgcgccgccatgtacgctaattagctttaatatttgcttcgccttcggtaaagcctcatcctccagcacgcgttcaaaactgttagataaattactggattttttttcataatcgcgacggttacgaaattgcgccagcgccgctgacatttcgtccgtcgactggacaaatttttgtacttccgcccctggagacgaatcctctgcggcctgttgtatttccgcctgttgcgcatcagtatgttgggtcgcatcctgatgagatgcctgccgggacaatattctggaaaatgaaataccagaggttgagccaggaatcatttaattacctcctgacctctatccagataaacacgaacccatttctgtaacttatcgtccccactccaggcaccgctttgcttcagaatattgtttaccgattcgctggcatccggcgttaacgggtcgacaatttcttttggttcaatcatgaacacacgaacaacattacttttattcttactggaataacggaacaggctaccaataagcggtaatttgcctaaaaccggaatactttggacagtatcggtatttgcatcccgtgtataaccaccgaccagcaaactttttccgtgcggaactcttgcaatagtgctaattaacgttcgcccgacttcgggtaacgcatctacggaggtggtagtatcggattgcggcgtcttatcgttgccatcttcaatgtccagcgacatttctatctgaccatctgcggaaaaacggggcagcactcggatcattgttccgtatgttacatgctcaagcgccacattacgttccccaatcagcttggtgtaaaacgttctgttgttatcaaaaatagcgggaacattttcctgagtcagtaataccggacgcgaaaccaccgtcgcctgtttcttctcttctaacgcattgaccgcggcgatgaatcgactgccatcgagggtacttattgaagactggtttaatgacacgccaagtttgtccccaatagttatgctgccgctccatgaagtgcccaaacgctccagatcgcttttattaagatcgacaatccacagggataattctacgtgacgtttggcgacatccagcgctttaaccagcatttcgataaaatgcacctgcccagccgttccctttactaacaaactgttggtatccggataggccacgattttaatattgcccgccgcggcattttgctttaaagcttcctgcagactcatgccaccggcataatttgctgctttacctttttctccattcgctgaaaatgctggcatcgccgggggttcgctactgacaatattacctaagggttgctcttctccctgcaataacctttcaatggccgtagcaataccgggaataaccattttctgatcgcgcagattgtaggtacgatcgcccacgaaggtattgttcagacgcatcacccctattttctggcgtcccagctcaataccatcgttttgcttgtccatcatggtggcggcgttgaccaccatatcaacatagacgggtggccctgaaacatagaatgttcctttacggttatcgccacgtagcgggtaatttttgttatataaacctgagcgttttagaaaattgttgaactcattgagtgagacgttgcgtaaagaaaccacggcattgcgcatttcactggcgtcataaatatagatagcctgcccatcgaaataccaaatcagccccagttgtagggaaagcttctccagtaatgcgttaggatcgtgaaactcaaagttgcccgtaattttttttcgtgccgccattttgctaacaatgacaggctcctttagctgtagcgccatggcatcgaaaaatgtccgcaggctatcgtctttcgcaacaaacccacttcccgttacaggtattttttcactagaataaccaggtgcaaccagaacaagcgcggcacatgccagcactctggccaaaagaatatgtgtcttcatttgtctgccaattgaataatatttgataatttccgcggcgaaacgccgatcagctctttgatctcactagaaaaatgtgaaggcgatgagtaaccatgattaacggctaattgggtgatgttctcgtggccttctacactattcagcagcgattgcgccatacgccagtttcgtaattcactcttcgcttttccgcccaacgctctgctgcacaaacgacgaaaatgggtataagaaacgccatagtcttctcccagcattctcatcgtgttgccgctggttgactgagcgagtaaatagccaaccaaccagtaactctcgctttttcgtaacagcgccagtaccttattgaaggccggagaaggcgtaataatttgctgcaaaaaccagtactcgcagcgtttacgatcttgccaaatagcgcgaaactcaggactcagcaaaacccatttatcggattcagcatatgtcgtgtccactaatcctgcgccatcgataaatgccagtaatttgctgagtacttcaatttttaacggtcgaaaaaccaggtctcctgatactggtgcgacaacggcctgctcgcaaaaaagcagcgcgccttcctgaatcaggcagttttcattgtgtcggctttcagaaaatgacatatgcagcttttgcgcggaacacgtctgtataaaccatgcttccgggctgcggattttccgcttctctccttctttaagtacttcctgcgtatttagcattgttgtcagcaccagttaaaaatcattttaatatgtaaacaataccaggagcgggtggcaaaatcctgatgcaatcattatgaaactgatgccacccgctaattaaattagccaacttgcacagcgcttgctgatttaaaatagaaaatcagctcatagtatacaaattatggcttattgttctacagcagcaaaaattcagatattgtcatcgggatggagaattaattatttatatcaggagttttttttgctagcattcctgaaacgcattcgccccttatcactattgtcagataacattctgacggttgtgtaaaaacatggcgcctcattcttctgtagttggagttaatatgaaaaaattttatagctgtcttcctgtctttttactgatcggctgtgcccaggtgcccctcccttcctccgtgagcaaaccggtacagcaacctggcgctcagaaagagcaactggccaacgcaaatagtattgatgagtgtcagtctcttccgtatgtgccgtcagaccttgcgaagaataaatcattatcaaaccagaacgctgataattccgcatcaaaaaatagcgcaatcagctcaagcattttttgcgaaaaatataaacaaaccaaagaacaggcgcttaccttcttccaggaacatccacaatacatgcgttcgaaagaagatgaagagcaactcatgaccgaatttaaaaaagttctacttgaacccggaagtaagaatttaagcatatatcagacgttacttgctgcccatgaaagactgcaagccttataaggccatatcaccgctgactgaactcatcatgatataattaagaccatactttgcattgccacttaatatcaatataattattatagctatggtcacttttacggttggccatttgtctcttacgttgcatttatcaatctgctttttgatacagcagcacctcgctgctgctttttttatttgtgataaagaacggcctcccaaactcgggaaaatagccgaaacttatactgataaactatcgtctcgtatatcgcgataaactgacatccccctcttgccccacatgttggcattcttacgataccccatccacttttcgcggataacgttcttttgaacttacccagcaatagtggacacacaactaagtgagtaaacgctcaagcaagaggtgactcacataacaaaaccagcatcaaccaccaaaaagccacgcaagcagcacacgcctgaatttcgtcaggaagccctgaaactggcggaacgcattggggtgcccgctgccgcccgtgagcttaacctgtataaatcacagctctacagctggcgaagcaaacagcaaactcagctctcttcttctgaacgtgagcaggagatgtccgccgcttagggttgtgtccatactacgcgggtaggatcaatcaagcagttacggcaaaaaagagaatcatgaatatatttagcaaactccctgatgatacgtaatcagtgagattaaaataatgcaatcgcgataaaccgaagttaatgccctgtttaaagacagtgaacgaccttcttgccatgtctggactatatcagcctcacatgtacgctttgaaagcgtacagatatgtattataattgtacatattgttcataaacaggaggatgaaaaccatgcctcagatagctatagaatctaacgaaagattgtcgttacgtgtatcgacggatgccaaaaagttgatagtccgcgctgcggcaatccagcaaaccaacctgacggattttgtggtcagtaacgtactacctgtcgcacagaagattgttgatgccgccgaacgggtatatctgacggagcgtgatactcaaatgatcatggaaattttagataacccgccagcgccgaatgaaaagcttcttgccgctgctttcgccctgccggacatgaagaaatgatgtttacagactggcatgaggccgcgatagggaaaacccacaatcgaatgaattttgattgtggggatgccgatctgaaccaattcctgcaacgccatgcacgacaaaatcatgagaaagggacaacaaaaacctacgttgcgcttgataattcggatgttacacgtatccacggcttttactcagtcagtcctgcatcactgatatatgcacaggttcccggcgcaatcagcaaaggattagggagatatgatgtgccagtgtttcgtctgggtcgtttagccgtagacaaatctatgcaggggcaagggctgggagcacaacttttgttatctgccggaaagcgttgcatacaggcggctttgcaggtcggtggcgtagccctgcttattgatgccaaaaataaacaggtctgcgactggtacaaaggatttggcgcagtaccattaaacgatcaacccctttccttgttgctgtcgtttaaaacgctttatgctgctttatctgcatctggtaggttatgacaacatgaggctttgttgaataattcagaatcggccaacgataaggatacaggactcccaccggagcactcgttatacgagcctgacgctggtcagcattgccaacaacgtcatccggttcagcgctttgaccatcgccatcgccatcgcttcacccacctgcgcgtcatagttccgcaggctcagatggccgcccagcaaggttttgagacggaacatcgctgtttccactactgaacaacggtgatagcccactttcttttccagacctcattgctgccgctcagatgttgattcgccaccgcgtggttacgctcatggtacttgcccggccagtatcgcgcaccgcttcgtggcgggattagcggcctgattaataacacatcatggcaatagcgcgtgtcataagcgccgtcagccgaggcttccctgattttacggtgagtctggctaatcagccccggcagtgcctgcgcatctgtcgtgccgctgagcgggaaagtatgcctttgcaattaatcaggaaagtgttgcgcgagaaatagcgcatctttcaagcacatcgtctactttaattaaccgattcataaaatatatattatctgttcatttctagcttgtaggctattttaataactgtgtattttaaacaataaaaattaatattaccctacttctttgttataataccagcctccaaaattgtgctataggaacatcatggaattaattcgttatgctgacatcaacagcgttctctatcgccacatttgggtcgttggtgatattcatggatgttactccttattgttaaccagactggctcaattaaatttctctcctgataccgatctcttgatctccactggagataacattgatcgaggaaaagaaaaccttgaaacactgagactgttaaatacctcatggtttatttctgtagtgggtaatcatgaagctatggcgcttgacgcttttgaaacacaggatggcaatttctggtatgtaaacggtggttactggtacgactcggtcacccaaaaagacaggcaagaagccactgagctattactaacttttaagcagcgtcctcacatcatagaggttaaaacgtcctcaaagaagtacgtgattgcccatgccgattatccagatgacagctacgattatgggaagcaagttgatattgatagcgttctatggtcacgcgatcgtctgcttagttcgttacaggggaatatccatccaatacgcggtgcggatactttcatcttcggccatatgattgttgattacacaacaacattcgccaatcaaatctacattgacaccggttctttctgttcaggcaatctgtctttttttaaaataaagtagtctggaaatagaattatataatattaaccctccctgcattatggcaatgatatagccttcaataagtaccattgctcattcgtaatagcgtctaaatttcgcgtttttccgcccatttcatcattaagatcgcagaccaaaaaacgaagccgtaatccgacgcaggtagttactcgatcgcctgagaagagtaaagatcgcacagctcaagatacctatcggaataaagcacaataaccgtggtggcgaaatggatcggcttgccttcatgcaacacaatcttgattacggtcttgagttcggaagcatccgtttccctcttaattttgttgtgatttctctttgttgcgaacatggtctgaactaattgcctgcagattgccttgtttcgtcaatatttggaaaatcgaacacattttcaacttttactttcaagacagaacttggcttcctaccctcactgacattacgatctgacgaggctactcttcgctggattacgtaggtttttttcgtcaaactggcttttaccccgaaaccagcaggagcttgtctgtggtcatcgaaaacaatgtagagtttttgagctgggttagcttcgaaaacgatttttccagagcgactgagcgcagacttaacattgatacttaacttgttgataatgaaaggctggctgagagttgttttcaaagtatcacccctgttgtagtccaggaatgatgagaatgtaacctgtcacattttaggctacagatgagctacaaatttatgggtttatgtgagtttataggggttttacctatggccacatgagcacttgaaagaataaaaaacgagtaaaatcaatatgaatgagtcatttgataaggacttctccaaccacacccccatgatgcagcagtatctcaagctgaaagcccagcatccggagatcctgctcttttatcgtatgggagacttttacgagctgttttatgacgacgcaaagcgtgcgtcgcagttgctcgatatttcgctgaccaaacgcggcgcatcggctggcgaacctatccctatggcgggtatcccgcaccacgccgtagaaaactacctcgcgaaactggtcaatcagggcgaatccgtcgctatttgcgaacagattggcgatccggccaccagcaaaggtcccgttgaacgtaaagtcgtgcgtatcgttacgcctggcaccatcagcgatgaagccctgttacaggagcgtcaggataacctgctggcggctatctggcaggatggtaaaggctacggttacgccacgctggatatcagctccgggcgctttcgtctgagcgaacccgccgaccgtgaaacgatggccgcagagctgcagcgcaccaatcccgccgaactgttgtatgccgaagattttgctgaaatggcgttaatagagggacgccggggtctgcgccgtcgcccgttgtgggagtttgagattgataccgcccgccagcagttaaatctgcaattcggtacgcgggatctggtcggtttcggcgtcgaaaatgcctcgcgtggattatgtgcggcaggctgcctgttacagtacgtaaaagatacccagcgcacctccctgccgcatattcgttccattacgatggaacgccagcaggacagcatcattatggatgccgcgacccgccgcaatctggaaattacccagaacctggccggcggtgtcgaaaataccctcgccgcggtgcttgactgtaccgtgacgccaatgggtagccgaatgcttaaacgctggctgcatatgccggtacgaaataccgacatattacgtgaacgccagcagaccatcggcgccttgcaggataccgtcagcgaactgcaaccggtgctgcgtcaggtcggcgatctggagcgcatccttgcgcgtctggcgctgcgcaccgcgcgtccgcgcgatctcgcccgaatgcgtcacgccttccagcagctgccggaattgcacgctcagcttgaaaccgttgacagcgcgccggtacaggcgttgcgtaaaaaaatgggcgatttcgccgaactgcgcgacctcctggagcgcgccattattgacgcgccgccggtactggtccgcgacggcggcgttattgcgcccggctaccatgaagagctggatgaatggcgcgcgctggcggacggcgccaccgattatctcgatcgtctggaaattcgcgaacgcgagcgtaccgggctggatacgctgaaagtcggctataacgcggtacatggttattacattcagattagccgtggtcaaagccatctggcgcccatcaattatgtgcgtcgccagacgctgaaaaatgccgaacgctacattattcctgagcttaaagagtacgaagataaagttctgacctcgaaaggcaaagcactggcgctggaaaaacagctatatgacgaattgtttgatctgctgttgccgcatctggccgatttacagcagagcgccaacgctctggcggagctggatgtgctggttaacctggccgaacgcgcctggacgctgaattacacctgcccaacatttaccgataaacccggtatccgtattaccgaaggtcgccacccggtggttgaacaggtactgaatgagccgtttatcgctaacccgctcaatctgtcgccgcagcgccggatgttgatcattaccggccccaatatgggcggtaaaagtacctatatgcgacaaacggcattgatcgccctgctggcctatatcggcagttacgttccggcgcaaaacgtggaaatcggccccatcgaccgtatttttacccgcgtcggcgcagcggacgacctggcttccgggcgttcgacctttatggtggagatgaccgaaaccgcgaacattctgcataatgcgacggaaaacagtctggtattgatggatgaaatcgggcgcggtacctccacgtatgacgggctgtcattggcctgggcctgcgcggagaatctcgcgaataagattaaagcgttaacgctgttcgctacccactacttcgagctgacccaattaccggagaaaatggaaggcgtggcgaacgtccacctggatgcgctggaacacggcgatactatcgcgtttatgcacagcgtgcaggacggcgcggcaagtaagagctatggcctggcggtcgcggcgcttgcgggcgtccctaaagaagtcatcaaacgcgcgcgccaaaaactccgcgagctggaaagcatctcgcccaatgcggcggcaacgcaggtggacggcacgcaaatgtcgttgcttgccgccccggaggagacatcgcccgccgttgaagcgctggagaatctcgatccggactccctgacgccacgccaggcgctggagtggatctatcggctgaaaagtctggtgtaaacgtgtcagacccgatagcgccgcgctatcgggtctgcgcgccggaacaggcttttcaggctgtggctgtcgtttcatgtaaatgacgccagactatccgtcctctttccctttttaaaatgaccgtcgaccagcgtaccgtctcggcctggcccggcagttgctggcgctcacgataacgcagcgcggcgccttccggccactccgccacaagatcaatgtgctcaaccatgataaccagccccgggcgacacgcgcgctgcgcctggaaaaaagcgcccagcgccggataatccagacaaatacctcctggcgttatcatcgtaaaatcaacagcaaaacgcgctatcaacgcctccaggctaccccccccccccttactaagccagttctcaatcgccgcatgggcatgaataatttcttctttatatggattcatgatctttcctttttcaggcacagaagcgcctgtctattgtttagacagacagcgtaaataaggggcagcagggtgataccggcggcggcaataaaggtccagcgataagcaacctcaagcgacataacgcgctggagcgcgtttaacagcagcgtcaacagcgtcgcgccaaggaaaaagctaagctgacgattaagattccatagcgcgctggcgtcaggcatgtcccggcgagcaatagtcaggaaagcgccactctgcgcggtactgctgcacaaactgccgccagcgcccattaaggcgaatatcatcatcagtacacgatgcgatgtcgcaggcgtaacgttagttaaaagcagtatccctgcagcctgaagaagacagccgacgataatcagcggacgcggcccaagccgattgaagtaacgtccggtaagcataatggcgacaaatgaagcgatcgaccaggggagcatcagcgaccccgccgccgcaggcgatagctgcgcgacgttctgtagataaaacatcccgaccacgctgataccaatgaacatacccggcacacacagatagacgatcatggcaaaacgcagcagcttgtccgtcaacaacggcagatggagcaatcttgctgacgccattgtcgtcgaagcgacgttcagccaacgataagcgagcaataaagtgagaacggccaccggcagcgtggcaaaaaatatccagcgccagccgcacgtttccaccagcagcccgccaatcgcaggcgaacatgccggcgccagtagcgccaccatcatgacgaccgatgacacgccagcgcgttcatgcggtttaaactgttgccaggttaacgcctgaccaaccgggatcaataagccaccgcccgccccctgcacaatacgccagaaaacaaggctgtgtaaggaatcggcaaaacctgcggcagcggcggcaacgctaaacagaatgagcgaaaatatgatcagccgtcgtgcgccgagataacgtgaaagaaacgcgctaaacggaacgatcagcgttaatcctgcgatataaccgttactcacccatgccagcgccgatatggacgtatgcagatccacggacatcgcaggaaaagccacgctggcaataaacagattaatcagatcaagaaagaagccgagcaggtaaaccactgccactttactgcgatacgtcattatgcatcctccgtcagaggcgctaatgtagccgtccggagaaagccagataagtccgcgcttcaacgatatactgtcaaaataattttgacagtaaaggagctcgccatgctcaatttgcagcgtatgtcgctgtttgtcgccgtggtagatagcggcagcttcacggcggcggccgccgcatcgggccaaacaaaagcggtagtgagttttaatattcggcagcttgaaaaagagcttggcgtaacgttactgctacgttccacccgacgactgacgctcacagacgccggcgtcctcttttaccaaaaaggcgtgaatttactcaatgcagcgaaaaatttgcaggatgaagtgcgtgccagccatagtgggctgggcggcgagttacgtattaccactacgcccgagtttggcgaacaggtggtcattccggtactggcgcagtttagtcagcgccatcccgatctccgtattcggcatatgtcctcatcacatcatgccgatttaattgccgagcgctttgatgtggcgattcggcttggctcgctggcggactcccgctatcgcgccgcgctgatatcccgctttaccattctgccggtcgccgcgccgcagtggctcgcccgccaccccgtgtcgtcactggagtcgttggcccaggcggaatggattattcatgagcgattacctacgccgctacggtggacagtaacgaataatcatggccaacactcacgcctggagataagcaaagccggcaaaatttctgtcgacagcgcgcgctcgctgatggccttcgctctcgcgggaagcggcgtcgcattactgccgcaatggttagtcaacaccgcactggaggatggaacgttaattcacgtgttacccgactatcattttccccgtcagggcatttatgccgtttatccagacgcccgccatgtatcgacaaaagtacgcgcatttattgattttttacgttcgcaatgggattgcggggagcacgccccatcattgtagccagcccgggagcattgcgctcccggacggataataccgtcttaatccttaactaccagtttgtctttgatcccctgcgcctgccaacgcacccacagcataattgccgccagaacgacgattggcagtaacggatcgagccaactgccgccggaaccaaacagcaggttaatcagcgccacgccggtgccgccaatcgcccaggcaatggtcgtcggtacagaccaaaccaccatctgctgtttgacatcagagacgcccatcatgcggttaaccacccagaacaggctatcgttgaagtagccgaaaaacagcgaccccatcgttgcggcctgagcggcaagcaacatattgatgccggggatctgcgccaggatcggcgcggaaatcgaggcggcagtgatcatcgccaccgtccccgatccctgaatcagacgtaccagcgtcgccacgataaacgggatcaggatcggcgagatcggcaggttggcaacctgctccgccagctgttgccccgcgccgctgtcgcgcaggatcgcgcccaacgcgccgccagcgcccgtgaccagtaagataatcccggcgctttgcaagccctcttccagacgctctgcggtggtatgtttatccatgcgcggcaccagcgtatacaccgccagcagaacgctgatggccaacgcgatcactggacttcccacaaagttgattgcctgtaccaccggatgcgtcgccaggccggaccatccttctacagtggcgagggtggaacagatagccttcaggaagatcagcacgatcggcaccacaataggcagcagagagagcgtcaggctcggcagatccttttgctctttctctttattgtactgctccagcgcggcattaacttcatcggcgttcagcgtgcgcggcacgaaatcagggtagcgtttatccagccactgcgcatagaacacaatgccgatcacacagggcaccgccagcgccatcccggtcaataacattgcaccgatgtcgacgttaaaaatcccggctacccccagcggaccgggcgtgggaggtaccgtatggtgagtgaccaccagcccgcccgccagcgcgacgcccagcgtcagtagcgaacgtttaccgcttttcgccagcgctttcgccaccggataaagaatgacaaaagcggaatcgacgaaaatggggatgctgacaatataacccgtgatcgccagcgcccactcttcacggcgtttccccagccatttgataaagctccaggcgatacgctccgccgcgccggaaacctccagcaagcgccccatcattacgccgagaccaatcaccaggccaatgctgcccagcgtcgtaccgaatccgctggtgatgacagagagcgttttatcaatgcccattccccccaacagaccggcgatgcaggccgccgccagcatcgcgatcagcgcatgaacacgggtgcgtaacaccagccataccagcacgaaaacggcaacgatcaggccgataattggggtcggtaaacttgtcatgacctcccctccatatcatcttgtcgaaagcgttcgataatgtcatcgaagcgtttatcggcgacaaaacctaacgccagcgcacgctggttatcgatacgtcccggccaggaggcgacaattttctcgacgccttcgtcgcgctgatgcgtaacccgatcgcgcgccgcctgaccgcccgcctgacgcaacgtttccagcatctcgcccacggttacgctgatcccgggtaagttgatgctgctcgcctcgccaggcgcgggtaacgttgcggccagcgacaggttatggatcaccgtcgccgggctggaaatccacagccgcaaactttccgacaccggacagatggtcgtctcgccctgcaacggttcacgaataatcgcgctgacaaaagaagaagcggcgcggtttagtttacccgggcgaacacagatcgtcggcaaacgcagcgccagcccatccacatagcctttgcgggtatagtcgttgaccaacagttcacaggcggccttctgcgcgccataagacgagcgcggcgtgagcgcggtggtatcggtgacgcattccggcagcgtaccgccataaacggcaagcgagctggagaagacaaaacgaattttctgcggttgccgacgacacgcctcaagtaactggcgggtaagatccaggttaactttccatcccagatcgaaatcgtcttccgcatgactgctgacaatcgcagcgagatgataaacaacagaggtattagcggtaatcacattctccagtacgcccggctgggttaagtcagcttccaggcagcgtaaacgaggggaatctgataaccgtgcaggcatttttaaatcaacaagaagcagttcgttaaacgccagcgatgagtttaataaggcgcttgcgagtttctggcctaaaaagccgcccccgccggtaatgataatctgcatccggatgtcctctttattgttgtgtagggtagttcagggttagcgccaggcgttaaaccagccaagcccctcctgagtggtattccgtggttggtattcgcagcctatccagccgcaataacctacgtcatcgaacagccggaacagccacgggtagttgatctcgccatcatccggttcatgtctgtccggtagcgaggcgatttgtacatgggcatagcggcccgcgtactcgcgaatcaggtgactcaaattgccatccactttttgcgcgtggaaagtgtcgagctggatgaatacatttgggcggtcaacctcttctgcgatgcccagcgcctgatattggctggaaaagaggtagccgggtttaacgccgggactcagcgcttcgatcaaaatacgtttatcgtgggcggcaaaccggccggcggcataacgcaaattatcgataaacgtggcgcgataacgtgcgccatcagcgccatccggcacgacgcccgccatgatgtgaacctgctcgcattccagcgccagagcgtattccagagccagatcaatatcggcgcgcgcgtcgtgttcgcgccccggtagcgcggcacgtccccactcgcccgccgcggtatcacccgccgaagtattaaacagcgccagcgtcagatcatgacgcgatagctgggctttaatctcgctggcggcaaagccgtaggggaacagaaactcaacggcctgaaaaccggcttcggcagcagcggcaaaacgctcgataaacggcacttcggtaaacatcatcgacaaatcggcggcaaaacgcggcatcgggttatctccttaactgcgcaatttcttcggtggttaaataacgaatcgggcgttcgccaaggataaaaatcagctttgccgtctcttccagctcctcggtattattagcggcttcctgcaaattctccccgcacacgaccggcccatgattagccagtaaaaaggcctgatgccgggccgccagcgcagccaaatcgcgagcaattcggtcatcccccgggcgatagtagggaaccagcggaatgtctcccatccgcatcaccacatagggggtaaacgggcgaatcacattttgcgggtccagcccttcgagacaggaaagcgccgttgaccaggtgctgtgcagatgtaccacggccttgcagcaagggttattgcgatacaacgccagatgaaaacgcacctctttagacggtttatcgccgctgagccattcgccttgcgggtccactttggatagccgctgcgggtcgagattacccagacacgaaccggtgggcgtcgccagaatattgccgtccggcagtaacagcgagaggttgcctgccgagccggtggcatagccgcgctggaaaaacgaggcggctatcctgaccatctcttctcgcaaagcgtgctcttcttttgccagtatcgtcatacctgaaactccctttgagcgcggatgaaaaaggattcatcgccaaaattacctgactttagcgccagcgagactggcgcatggagcgcgttgacccacggcacgccgggtgaaatgcacggtccaatgtggaaaccggtaataccgaggctttgcgtcaccacgcccgaggtttcgccgcccgccacaataaaccgggtgataccgccttccgctaagcgagcggccagcagggaaaagagcgcctctaccgcatagctggcttcggtagcgccatattgctgctggatggcagccagcgcctgcgtggaggcggtggcgctaatcattggcgccagttcgctgtcctgactgaacacccactgcgccagcgcttcggcgtaggcctcgcgcgcctcggatgacaggcagcgcgccacgtcaacgtcgcgtgtgggagcatgttgtcgatagaaagccacctgctgattcgtcatttgcgaacaggaaccggaaagcactaccgcgcgaccgctcagcggatagcctgcggaacgggcctgagaaacgccgtgcttcgcccactgacgcgccagccccattgccagcccggaaccgccggtcaccagcggggcatcacgcaaaacctcgccctggatttccaggtgccgctcattgagcgcgtcaagtaccgcgtagcgatatccttcctgctgtaaacgcgacagcgccgcacgggtcgcggcaacgccttcatcaagcgtctgagccggaataacgccgcagcgcccttgcgcctgcgcccggtgtatcgctgatgcgataaacgttgctggcaacggcgtccagcacaggcttcaggcgggtaaacgccgcctcgcgcccggaggccatcaccgtccgccctgcgccgcttttaccgcgccgccggaaaccggcgcatccagcatgttaagattcaatgccgtcaacgccgcggcgatctcttgcgcgtcggcgcttgagatcgtagacgaaaccatcaccgcgcttccgggtttcatcagatgggcgacgccatcctcaccgaataacacctgtctgacctgggcggcattgacgaccagaatgactaacgcatccacgacgccggcgaactccctggcgctggcggcagccccacaagccccttcagcgagcagattcgcgcacgcttgcgggttaagatcggccccccatgtggaaagcccggcgcgcaggcatgaacgcgcagcgcccattcccattgagccaagccccacaatgccgacatgaaaatcagttcctgttgtcattatcactccatgttaatttacgtgatattatgttttgttatgtgaatataggcgtttttgtaaacaattgcggtgagttgtttcacaaaaaataacaaaatatgttattttttgtgaaggcaatcctcatagaacttcacacgctgtgacgagaaatcgcgtaaaatcgcgacaggactaaagaaaggagcagacgttgatacctactgagcgtcgacaaatcattcttgatatggtggcggagaaaggcatcgtcagtatcgctgaactgaccgagcgcatgcatgtatcccacatgactatccgccgtgatttacaaaaactggagcagcaaggcgcggtaatccaggtctctggcggcgtgcaatcatcgactcgcgtggcgcacgaaccctcgcatcagatcaaaaccgaactggcgacgccgcagaaagcggcgattggcaaactggccgccagcctggtacagccagaaagctgtatctaccttgatgcaggtacgaccacgctggcgatcgccaggcagctggttacgatgaataaacttacggtggtgaccaatgatttcgttatcgccgattacctgatggacaatagcggttgcacaattattcacactggcggggcggtatgccgggaaaaccggtcgtgcgtcggtgaagccgcggcgacgcttttgcgcgggctgatgattgaccaggcctttatttccgcctcttcctggagcgtgcgcggtatttcaacgccggcagaagataaagtcacggtgaaacgggccgtcgccagcgccagccgccaaaaaattctggtgtgcgacgcgaccaaatacggccaggtcgcgacgtggctggcgttatcgctggcggaattcaaccaaatcgtcaccgatgacggcctgccggaaagcgcaattcgggcgctggctaaagtggatatctcactgctgatggccaaacaatagcgaagcggcgcaagccgcttacgtcatcatcttgcgaaccagttgcgtaaactgttcgcgttcttcagcgctcagtcgccccaaaaactcatcgtcaacgcgatcccccagtggtatcgcggcggcgagcaacgtttggccctgaacggtgagatagacaaaacgccgacgtttatccagcggatcgttttctcgctttaccagcccacgattttccatccggcttaacatctccgccagcgtcgctttagtgctgaccgccgcttcggtcagatcgacctgttcaatacccggatgttcagcaataacgcgcatcaccgcatattgaggtttggtgagctccggtagttcatgctgccagcgtgcggtatgttgctgaaaaagttggcgtaacagatgaaacgcggtgtttcgtaactccatgagcgctccggataaattaactttttctatcataacgacttatgcacggttttttaatgacgaatgctttagctaaacgtgcgcaggcatcgggagcgatcttgtcgcaaaggccgtgtgggcgtattttgatcaaaatgttcgtatacgaacgatatttgaggtaagaaatgagattgattgtggggatgaccggtgcgaccggcgcgccgcttggcgtcgagctactccaggcattgcgggcgatacctgatgttgaaacgcatctggtaatgtcaaagtgggcgaaaaccactattgaactggagacgccctacacgcccgctgaggtagccgccctggcagattattgtcatagcccggccgatcaggcggcgaccatttcctccggctcatttcgtaccgacggcatgattattatcccctgcagtatgaaaacactggcgggggttcgcgccggctatgccgatgggctggtgggacgcgctgccgatgtcgtgttgaaagagggtcgcaagctggtgcttgtgccgcgggaaatgccgctcagcacaattcatctggaaaacatgcttgcgctttctcgtatgggggtggcgatagtgccgcccatgcccgcgttctacaacctgccgcaaaccgttgacgatattatccagcacatcgtggcgcgcgttctcgaccagtttggtctggagcatacgcgcgcgcgccgctggcaaggactgcgacaggcagcaaatttttcacaggagaatggataatggcatttgatgatttgcgcagttttttacatgcgctggatcagcagggacaactgctgaaaatcagcgaggaagtgaatgcggagccggatctcgccgccgctgccaacgcaacgggacgaatcggcgatggcgcgcccgcgctgtggtttgacaatattcgtggttttaccgacgcccgcgtggcgatgaataccatcggttcctggcagaaccatgccatctctctgggtttgccgcctaacacgccggttaaaaaacagatcgatgaatttattcgccgctgggacaattttccggtagcgccggaacgacgggcgaatccgggctgggcggaaaataccgtcgacggcgacgcgatcaacctgtttgatatcctgccgctgtttcgtctgaacgacggcgacggcggattctatctggataaagcctgtgtggtatcacgcgatccgctcgatcccgataacttcggcaagcagaatgtcggcatctaccgtatggaagttaaaggcaagcgtaagctgggtctgcaaccagtgccgatgcatgatatcgcattgcacctgcacaaagccgaagagcgcggggaagatctgccgattgcgatcacgttgggtaacgatccgatcattaccctgatgggcgcaacgccgctgaaatacgatcagtcagagtatgaaatggcaggcgcgctgcgtgaaagcccctatcctatcgccaccgcgccgctgaccggttttgatgtaccgtggggatctgaagtcattcttgaaggggtcatcgaaagccgtaaacgtgaaattgaagggccgttcggcgaatttaccggccactattccggcggtcgcaacatgaccgtggtgcgtatcgataaggtctcttaccacagcaaacccatttttgaatcgctctatttggggatgccgtggacggaaatcgactacctgatggggccggcgacctgtgtgccactgtatcaacagctgaaagccgaatttccggaagtgcaggcggtaaacgctatgtacacccacggcttgctggccatcatctcgaccaaaaaacgctacggcggctttgcccgtgcggtgggcctgcgcgcgatgacgacgccgcacggtctgggatatgtgaagatggtgatcatggttgatgaagatgtcgatccatttaatctgccacaggtgatgtgggcgttgtcgtcgaaagtgaatccggcaggcgatctggtacagctaccgaatatgtccgtcctggaactggacccgggttcaagcccggcggggattaccgacaaactgatcattgacgctaccacgccggttgcgccagataaccgtggtcactatagccagccggttgtggatttaccggaaactaaagcctgggctgaaaagctgaccgccatgctggccaaccgtaaataaggagtaaccgatgatttgtccacgctgtgccgatgcacatattgaactcatggcgacttcgccggtaaaaggagtctggacggtatatcagtgtcagcattgtctgtatacctggcgcgataccgaaccgttacgccgtaccagccgcgaacactatccacaagcgtttcgcatgacgcaaaaagatattgatgacgcgccaatggtgccgagtatcccgccgttgctggcagaagacaaacggtaaaaaaaaggccagtctgtcgactggcctttttttgacaagggtacttactcgcggaacagcgcttcgatattcagcccctgcgtctgcagaatttcgcgcagacggccgcaggccttcaacctgaatctgacgaacacgttcacgcgtaagaccgatttcacggcctacatcttccagtgtcgcagcttcatatcccagcagaccgaaacggcgcgccagcacttcacgctgtttggcgttcagttcgaacaaccatttgacgatgctctgtttcatatcgtcatcttgcgtggtgtcttccggaccgttctctttttcatcggccaggatgtccagcaacgctttttcggaatcaccgcccagcggggtgtctaccgaggtaatgcgctcgttgagacgaagcatacggctgacgtcatcaaccggtttatccagttgctctgcaatttcttccgcactcggttcgtggtccagtttatgcgacaactcacgtgcggtgcgcaggtatacgttcagctctttaacaatgtgaatcggcaagcgaatcgtacgggtttggttcataatcgcccgttcgattgtctggcgaatccaccaggttgcgtatgttgagaagcggaacccgcgttccgggtcaaacttctcgactgcacggataagccccaggttgccctcttcaatcaggtccagcaacgccagtccacgattgccataacggcgggcaatttttaccaccagacgcaggttactctcaatcatgcgacggcgagaagcgacatctccacgcagtgcgcgacgcgcaaaatagacttcttcttcggctgttaacagtggtgaatacccaatctcaccaaggtaaagctgagtcgcgtccaacacacgctgtgtggccccttgcgataacagctcttcttcagccaggtcgttatcactgggttcctcttcactcaaggctttttcgtcaaaagcctctactccgttctcatcaaattccgcgtcttcatttaaatcatgaactttcagcgtattctgactcataaggtggctcctacccgtgatcccttgacggaactagcaagtcaaagcctggttccgccgctttatcgctgcggtaaataacgcagcgggtttacggatttccccttgtaacgaatttcaaaatgcaagcgtgtagagctggtgccggtgctacccatagtagcgattttttgccccgccttaacttcctgttgttcccggaccagcatcgtatcattatgggcgtaggcactcaggtaatcatcgttatgtttgatgataataagattaccgtaaccacgcagtgcgttaccggcatatacgacgcgcccatcagcggttgcgacgatagcctgtcccttactgcctgcaatgtcgatccctttattgcccccttcggaagcgccaaagttttcgatcactttgccatccgtcggccagcgccatgcggaaatcggcgcgctggttgacgtactgcttgcatttggttcggtcgtgcttaccgttggtgccgttacaggcgctgtgacaaccgtcccagcaggcttgttgtttggcaacattttgttagcactttgttcacctgagccctcagaatacgtaattgttggttgagacgcaactgcaacggtggaattttgtgcagacctggtcacaactccttgctgtgctgcatccgcctgggtgatcgcatttccgccagtaattggcgtaccggatgcgttaccaacttgcaaagtttgccctacattcaggctatacggggcagaaatactgtttctctgggccagatcgcggaaatcattcccggtaatccaggcgatgtaaaaaagcgtatcaccctttttcacggtgtaagtactgccgcccgtatagctacctttcggaatattcccatactggcgattgtatacgattcgcccattttccatctgcacgggttgttccgtgaccggttgagtttgcatgggctgcgttacaggacgctgaacgggttgaatttgcggcgcttgttgcggcgtcgcgcccatttttggcggcggtgtgatcaacatcccggaattggtatttgatgacgacccactgtccacagacgtgaccggcgccggagggtttgacgaactggtacaacctgccagccatagtgaaaccagtgatagtgccgcaatgcgactaacggtgaattttgggcttcccgcgctcatttatcccccaggaaaaaatttggttaacaaccagtgacgtaagaaccgtgcaacgcattaagtgaacacgggaaaatgtgttcacgatacgcttaacccaccgggaataaccaggaaaactccaggtattcgtttcggcttcatcaggcgtaatagtggctgtttgcagggcaaactaggccagctctcccttgactaacgggacgaagcgaacggcctccacggtatcgataataaattcgccgccccggcgacgcacgcgtttcaaaaactgctgctcatcgcccacaggcagaacaagaatgccgccttcatccaactgtgccatgagcgcggtaggaatttccggcggcgcggccgtcacaatgatagcgtcaaacggcgcacgcgcctgccagccttgccagccatcgccatgacgggtagaaacattatgtaaatcgagctgcttcaggcggcggcgcgcctgccattgcagccccttaatccgctcaacggagcaaacgtgatgtaccagatgcgctagaatcgccgtctgatagccggaaccggtgccaatttccaacaccctggattgcggcgtcagttcgagcagttccgtcattcgcgccaccatatagggctgcgaaatcgtctgaccctggcctatcggcaaagcgatattttcccaggccttatgttcaaacgcttcatcaataaatttctcgcgcggcactgcggcaagcgcattaagcaccagctcatctctgatgccctgcgcgcgcaattgttcaagaagagcctgtacacgtccacttaccattgcgtgccaactcccacgctgtctaaccagtctgaaaccacatcatgcgcgctgtgcgcggttaaatccacatgcaacggcgtgacggagacgtagccttcatccaccgccgcgaaatcggtatccggcccggcatcgtatttatcacccggcgggccaatccagtacaatgtattaccgcgtggatcttcctgcgggatcactttatccgctggatggcggctaccgcagcgagtcacgcggatgcctttaacctgcgctaacggtagatccgggacattcacgttgagaatacgcccggtacgcaacggctcccggcttaaccctcgcaaaagcgcgcaagtcacggctgcagccgtatcataatgctgatagccgttaagggagaccgctaatgccggaaagccgagatgacgaccttccatcgccgcggcgacagtaccggaatagatcacatcatcgcccagattcggacccgcgttaataccggaaacgacaatatccggacgcggacgcattaaggcattaacgcccagatagacgcaatcggtcggcgtccccatctgtacagcgatatcgccattatcaaaggtaaaagtacgaagcgaagattccagcgtgagggaattagacgcgccgctgcggttacgatccggggctacgacctgtacatcagcaaactcacgcagcgctttcgccagcgtttgtataccgggcgcgtgaaccccgtcatcgttactcagcaatatgcgcataatcacccattgtgttgatcagttcccttactacgctggtggcaaaactgcctgcgggcagccagaaacgtaactcgacggtaacgtcatcccaccagttccagcttaattgttgcggataaagcagcatcgctctgcgcgacgcctctactttttcgcgcagcaacagcgattgcaacaccgtttcctgggcaatggcatcttgctcaaacgccagcgccgcacgctgtgttccccactctccgctgcccggcaacgacgctgtaatcatcagctctttttcgtctacccggcgctgcaattcaggcagttcttcagatgtcgcgacgaaccagcttccacgccccgctaattgtagcgcatcgccgtcaacaacttgattaaagtctggtttcttcagccgctggtgaacaatttgattaaacaacgcgctacgcgccgccgacaaccaaaaactgcgtttattgcgatcgcgcaccggcgcgttactttgcgcccagcgcagcgcgccctgcaagttgctgccgccaatgccgaatcgttgtgcgccaaaatagttcggcacgccgccatcgcgaatcgcctgcaatcgtgtttcgacatcgcggcgatcgcttatttcacgcaataccagcgtaaaggcattgcctttcagcgcgcctaaacgcagcttacgcttgtgacgcgcgtattccagtactttacaaccttccagctgaaaggcgctgaaatcgggcatctctttccccggcacgcgcgcgcacagccactgctcggtaacggcgtgtttatctttttgcccggcaaagctcacttcgcgagcgtgaattttcaggaatttcgccagcacgtcagcgacaaaacgggtattgcaaccgtttttcaaaatacgcagcagaatgtgctcgccttcaccatccggcgtaaagcctaaatcttcaaccaccacaaaatcttccggattcgctttcagcaatccgctaccttgtggttttccgtgcagccaggtgagattgtcaaactctgtcatttcgccgccttcatcagcaacgccaccgcttcgcaggcaatgccttctccgcgtccggtaaatccgagcttttccgtcgtcgtcgccttcacgttaacatcatccatatggcagccgagatcttcggcgataaagacgcgcatttgcggaatatgcggcagcattttcggcgcctgcgcaataatggtgacatccacgttgccgagggtgtatcccttggcctgaatacgacgccaggcttcacgcagtagttcgcggctatccgctcccttaaatgccggatcggtatccgggaagagcttgccgatatcgccaagcgccgccgcgcccagcagcgcatcggtcagcgcatgtaacgccacatcgccatcggaatgcgccaatagccctttttcataagggatacgcacgccgccaataataatcggcccttctccgccaaacgcgtgtacgtcaaaaccgtgtccaattcgcattatgctttctcctggtggatggttcgggtcagataaaattccgccagcgccagatcttccggacgggtgaccttgatgttatccgcgcgaccttctaccagcgccggatgaaaaccacaatactccagcgctgacgcctcgtcggtgatggtcgcgccttcattcagcgcacgcgtcagacaatcgtgcaagagttcgcgggggaaaaactgcggggtgagcgcgtgccataaatcggcgcgctctacggtatgggcaatagcgtttttccccggttcgccgcgtttcatggtgtcgcgcaccggactggcgagaataccgccgacccggctgttttcgctgatggccagtaaccgcgcaaggtcatcctgatgcaaacagggtcttgccgcgtcgtgcaccagcacccactgcgcctttgcaacggcctgtaacccggccaaaacggaatcagcgcgttcgttgccgccatccacaacggtgatttgcggatgattcgccagcggaagttgggcaaagcgatgatcgccagggctgatagcaataacaacgcgtgtcacccgaggatgcgccagcagcgcatgaactgagtgctccagaatggttttattaccgattgagagatactgcttaggacattctgtttgcattcggcggccaaatccggccgccggcaccacggcgcaaacgtccaataaagtggctgccatgttaaatccctggatggtttatcgatgagtttgccccgccgttgccgcgcgttttgaggcgtcaggcaccagacgatagaaggtttcgcccggtttggtcatgctaagttcgttgcgcgcgcgctcctcaatcgcttcctggccgccattgagatcgtcaatttcggcaaaaagctgatcgttacgcgctttaagtttggcgtttgtcgcctgctgcgcgaccacatcatcgttgacgcggctatagtcatgtatgccgttcttaccgaaccacagcgagtactgtagccagaccagtaaagccagcaacagcagcgttagtttacccatcctgccccctgaaaaacggcatcatcatcccataacgtcctctgtgactccacattcaggacgggattgccgcgacaacgccggcaaatgtaccacatttgccggatgttacgtatacccgagtaaggagaacataatctcattgttggttacggtttgaattatgaccggaggcgcagtgataacccgtctaccctaatagccatatgaataacgcgccgaacagcgcgcctacggccagtagagtaaacatgatgctaaaaagtattttgccctttaccaacagatgcaacgcaatgccgataatcaccgataccggcattaacgcgaggaaaaagggccaagtatagaggaaaaaaaacagcgtgttagggccataaagcagaaaagggatccccaacgccagcagccatgacacaaagccgaccaccgcccccggaaatgcactggtggcgtcatcgtcgaccatgaaggcgtctgaccttgtgaaagtaatgttatggctattacgcatattaaatcctgtaaccttgaccataccgggcatacaagcccggtggtgtctcaggatctgataatatcgcgccgtctcagcaggtctaataattgggaaaccaaatttgttactaattgttcaccattaagatgaacctggggcgagtcaggcgcttcgtaaatggcgtcgataccggtaaagttacgcaactcgcccgcgcgcgcttttttatacaatcctttaggatcgcgctgttcacagatagccagcggcgtattgacataaatctcgataaaacgatcgtggccgacgcgctcttttaccagttgccgctcggcgcggtgcggagaaataaatgccgtcaaaacaatcaggccagcgtccgccatcagactggccacttcgcctacccgccgaatattttcctggcgatcggcatcgctaaagcctaaatcacggcacaaaccgtggcgcacattatcgccatccaacaggtaggtactgacgccacgctgatgtaacgcctcttccagcgcgccggccaccgttgattttcccgaaccggagagtccggtaaaccacagcaccacgccacggtggccgtggagctgttcacgagcggcgacagtaacgggatgagagtgccagaccacgttctcatcatgcagcgccatgtttatctcccagcaaatctcgggcgtcccagtgcggaaaatgacggcgtaccagcgcattcagctccagctcaaacgcactgtattccacgggcggcgtcgctccgcgttcatccagttcccgcaccatgccagcacccacggtaacgttagaaagtcggtcgataaaaatcagcccgcccgtcaccggattttgctgataaatatccagcgcgagcggctcatcgaatgtcatctctaccagaccaataccgtttaacggcaggctctcgacgtctcgttgagtcagattgttgatatcaatctgatagcaaatagcctcgatacgcgcgcgggttttcttacccgcaagtttaacgtcgtagctttggcccggcgccagcggctgttccgccatccataccacatcgatcgcggcgtgccgcgcaggtgccagcgtctcgtttgccgccagcagcagatcgccgcggctaatatcaatgtcgtcgttgagtaccagggtaatggcttcgcccgcacagacttcttctttgtcgccatcaaaagtgacgatacgcgccacgctggattccacgccggacggcagcactttaatgcgctctccgactttgacgctaccagacgccagagtgccggcatacccccgaaaatcagggttcgggcgattgacgtattgtactggaaagcgcatcggctgacggtctaccgcacgctgtatgtctaccgtttccaggacttccaacagcgtcgggccgctgtaccagcgcatattggcgctctgcgcggcgacattatccccttccaacgccgaaagcgggacaaagcgaatgtccagatcgcccggcaactgttcagcaaaggtcaggtaatcttcgcgaatacgggcgaaggtctcttcgcggtagtcaacgagatccattttgttgattgccaccaccaggtgtttgatccccaacagagtggagataaagctatggcgacgcgtctgatccagcacgcctttacgcgcgtcgatcagtaggatcgccagatcgcaggtggacgctccggtcgccatattacgggtatattgttcatggcccggcgtgtcggcgataataaattttcgtttttccgtggagaaatagcggtacgcgacgtcaatagtaatgccctgctcacgctcggcctgcagcccatctaccagcagcgccagatcgagtttttctccctgcgtgccatgacgtttactgtcattatgcagagaagagagctgatcttcataaatttgcagggtatcgtgcagcaaacgacctatcagcgtacttttaccgtcatcaacgctgccacaggttaaaaaacgcagcaggcttttgtgttgttgggcaatcatccaggcttcgacgccgccttcactggcgatttgttgtgcaagtatggtgttcatggcggctccttagaaatacccctgacgttttttaagctccatcgaccccgcctgatcgcggtcaatcatcctcccctggcgctcgctggtggtagaaaccagcatctcttcgataatttccggcagcgtttgcgcgtgggattccaccgccccggtgagcggccaacagccaagtgtacggaagcgcaccatcctttttttgatgacttcgccaggttggaggtcgatacgatcgtcatccaccatcatcaacatgccatcacgttccagaaccgggcgttcagcagccaaatacagcggcacgatgtcgatgttttccagccagatgtattgccagatatcctgctctgtccagttggagagcgggaagacgcgtatactttcgcctttattaatctgaccgttatagttacgccacaactctggccgctgatttttcgggtcccagcgatggaaacggtcacgaaaggagtaaatacgttctttcgcgcgggatttttcctcatcgcgccgtgcgccgccgaacgcggcatcaaaaccgtacttattcagcgcctgctttaacccttcggttttcataatgtcagtgtgtttagcgctaccgtgaacgaacggattgatgcccatcgccacgccttctggatttttatgtaccagcaattcgcagccgtatgcgttggcggtacgatcgcgaaaggcgtacatctcacggaatttccaaccggtatcaacgtgcaatagcgggaacggtaacgtacccggataaaacgccttacgcgccagatgcagcatgacgctggagtctttaccaatggagtacagcatgaccggattagcgaattccgctgctacttcacggataatgtggatactttccgcctccagttgccgcaggtgggtgagtcgtttttgatccataaccgttcctttgcaataccgttttttgctaaacatttcgattacacgactatagggagcgcgggagagtgaatgaaatgacgaattggaatgagtagttcctcaaaggaataacgcggcccaaaaaccaatatcaaaaaatgcttaacgtaccggattgccagcatttaggagcaaatgaaattgtattaacacgatcgcggtttcatactagccccgtaaaattttgttctgtatttaaggactcattatgttttccgcaacgcgccgctttgccgtcattctggcgctcggcgtaggctttatccttcctgcacaagcagcatcaccagggcctggtgaaatagcgaatactcaggcacgacatatcgccaccttttttcccgggagaatgactggctcccccgccgagatgttgtctgccgattatttacgccaacaatttacccagatgggataccaaagcgatattcgaacgtttaatagccgatttatttataccacgaaggataatcgcaaaaactggcataacgtgacgggcagtacggtcatcgccgcccatgaagggcgcgtgccgcagcagatcatcattatggcgcatctggatacctacgctccgcagagcgatgctgatgtcgatgccaatctgggcggtttaacgttacagggaatggatgataatgccgcgggattaggcgttatgctggaactggcggcgcgtctgaaagatataccgacccattatgggattcgttttatcgccaccagcggggaagaagagggaaagctaggcgcggaaaatttactcaaacgaatgagtgacgctgagaagaaaaatacgctgctggtgattaatctcaataacctgattgttggggacaagctctattttaatagcgggaaaaatacgccggaagcggtgcgtacactgacccgcgatcgggcattagcgattgcgcgccgttatggcatcgccgccaacaccaatccgggacgcaatccatcctaccccaaaggaacgggttgctgtaatgatgcggaggttttcgataaagcgggaatatcggtgctttctgttgaggcgacgaactggaatctgggtaaaaaagacggataccagcaacgtgtgaaaaatgcatccttcccgaacggcaatagctggcacgacgtacggcttgataatcaacagcatatagacaaggcgctgccagggcggattgagcgccgtagccgcgatgtagtgcggataatgctgccgttggtaaaagagctggcgaaggcggaaaaaacgtcctgatatgctggtgaaacgtgtttatccccgctggcgcggggaacacggacagcaacccgtgtcggatatcagacagatcggtttatccccgctggcgcggggaacacacgcgaatcgccaatcgccgccgcgtgaattgcggtttatccccgctggcgcggggaacacccacgatgtatgccgaccgtgatttttaccgccggtttatccccgctggcgcggggaacacagatacgcctttacgtcgccctctttggcgcgcggtttatccccgctggcgcggggaacacattaaaaaagattaatgttggttatagttttacggtttatccccgctggtgcggggaacactaaaacaccggttgcgcaacctccgcggggatcggtttatccccgctggcgcggggatcggtttatccccgctggcgcggggaacactctaaatctacccaattgaatttaaatacttttttagcgcacaaaaaacccaccaacttttcctaatttttaaagatctctaacttattgattttcaacaggtagaaacgacaccaatcgcagtccatcaagatctaccggaatacgtcgatttacaccaaaagtctgaaactcaaaacctgattctgtatttgtcgcccacgccataacaacatttccctcatctgccagaacggaaacctgttgccatatcatctcgcggatctttgcggaaacatcaccaacatacacaccagctcgaatttccagtaaccagacggccagcctcccccgcagacgaggaggaacattttcggtaacgacaaccagcatactcatcgttaggtactccgatgaccggaatctcccaacgcaacaggaagagggatcgctatggggtgtgaatcttcaggaggtaacggcggttgaatttcccctgccgcgagaacatcttcaataagaggaatcaatttcgccaatgtttttccactgcggaagatatcccggcaggcaatacggacatcacgatcgggctcggcaggattacgtcgcgcaatttcaaatgctttcggtacaacgatctcaaatttaatgatatcggcaatatcatagacaaaagaaagcggcttgccggtgtgcacaaatccaatcgcgggcgcatatccggcagccagtattgccgcctccgttacgccatagaggcaggaggttgccgagctgatacactgattaatgacatcgcctttctcccagtctttcggatcgtagcgacgtccctgccatttcacgccatactgcttagcaagtagtgcataggttgcccgcacacggctcccctcaataccacgcaattgatctacagaacgacggctcggcgcgggttcgccaaaacgtaattcaaacattttacgcacgaccttcagccgcaaatcttcatccagtgcaagtttcgcctgataaagcaatttgtcggaacgggcaccaccaggctgccccgaagcgtaaacgcgtacgcccgcttcccccccccacaccagtaacgtacccaccgttgccgcaagtcgcacggcggcatgggaaacccgcgtccccggttccagcatgatgcaggccaccgatccaacaggaatatgggtacgtacacccgttttatcgataagcacaaacgcaccgtcgatcacatcaatttgtccgtactggagaaatatcatcgaaacacggtctttcaacgggatgggattcagcggcagccagctcatcagcgtttcctttttaccatcagcattccgcagcccagcgctttacttttacctaatccggaaaataaagcctgtttaaacagtgctgcatcggtgatacagagcgcaccgctaaaatcaacgctactgaaagtgattggggtttcctggtctttacggacaaaacgatgttgctgatacgcttgcacgcatccacaatgcgcctgcaattcactgtactcgtcaccagcccacatagcgaaatcatcaggttccggtgcaatcaaccggaaaccatgctgctgcccttgttgttccagccacgcctgcgcggcctgctgttgaagctcccaccaccgttctttctccacaccattcgccttcgcctgatgtttcgcgttcatcatcacgtcactgcgcttaccgttacgggttatcaccgggttagctcgtagttgaaaatcaagctcaagaccatttgtcagttgcggattaaatagtttggtttcaataagaaacagggagtgctgcaataacggcggtattgccgagagcataaaaaagccgccatgcgcctcttcgcgaaacagaaactgacgcaattcctgttccggaaagagctgccataaccactggtggctggcataaggcctggctgaattccactttgccaacatctccggtcgcaaattattaaaccggagttgaatacgagaaagatacattatgttctctcctgcaacggcccattgaagcgggtgtagccgccaaactgccagcgttggcggctaactggctggttattgctatgctgcttttgttgccagaccagactctcctcatcaggatcatcccaataacaaataccctcacgcagggtaaatccacttaattccgctgcggaaatctcctccacagcatgagtgaatacctcttttaaggtgccggtcattaaacgcgccgctaacggtaacgccagcgggcaggattttctccccagatagagcggaaaatgcggtgtcagcagcgcctctcgcaattcgctaagcgaatatggtgcatcaggcgtggcgcttattgccacatgccagtagccatcgcagcgatactctcgctgcgagataagcgttcccacttcatccgacgcgagagtcagttcatcccggcgcgtgtaataacgatactttttgttttctcgcggcgcgctaaccgtgtgataatcccgcaaccagcgatcttgtgaagccaacgcgtgcaccgccagatgatagtgccggttaaagttattcagccgcgcttcttcgtcgcgacgaattcctaacgctgcggcaagcagacccaatagcgcagagcgcgtgggaaccgtagctgagtggcgaatctcgccagacgcttcctccccccacgacgccagcggcgcataaagctgaaaaaccagatattccttcattattcatccttactggctaacaaaggccagtaattccgccagagatcccgtaccttcctgaacgttcaactcacgataatcgtctgcacagtttccatatacgctatcgaagctggcgcgctgctgttttaaacgggttattgccgcaggaatttgatcggtatcgcgtaccggctggaaaaatgccgccgccagagaacgcggttgtttttgcccgacttcggccaacgcataggtggcataggcacgagaagcgaagctgttttgtttaccggttggcgagacggttaacgctgtttcagtgagtgccgcgatagtacgcttcgccagttcttcgttaccacccaggttttccaccagcagatcgcggctgatacagacataggtatagaaaagcgccgaggcaaaaccctgctcgcccatatgcccggaacctgcgtcttcctctttattattcagatcgtcaacggcggtgaaaaaatcagactcaacggtcacggcacttacgcccaacgcatgggatacctgacaagcagcctcgacgttgaactcaggcgatgacgccagcatacggtcaaacagcgccatatctacgctacgctgttctttgcgcagaagcttcacttcttcatcgttaggttcgcgtttgtcggcaattagcgtatcaaccagttgtttaatcaaactaatttcatggttactgacgtgaacgatctgctcaatttcgagatttttttccggtttcgcatctttatcacttttaagcttgccaaattgcttagcgattaactcagacgaactcttagcaattttttcttcaattccggcatctttcatcggacgataaacataatccacgccaattcgacgagtacgcttacccataaagccatccattgccgcttcaaaagtttccgacacccgccaggcacgcttcagactttgcgacgatacgcgtaaacgctcaactcctcccataaacgcggtcttcggtctgccagactcatcacgattcaggttagcgggcgcataagcagtcaataaatgcagttgaataaaagttgtcattatcaaatccttctaaaaatgattatttgccacgcgacgtggaaagatattcgttcgcccaacggatgcgacttcgttcaaaggggttacggaattccggctgatggttttcgcgtcgttgccactcttccatccacaggaaaatgccatcggcaagtgaaagaacattcaccccctccgtaccgcgaatcttcactgcctgaatcaacaactggcaaaatgtttccgggtcggacgctttttgcaaacgttcaaaacgcagaccagaaacgcacgacgtggaacctttaagcttttcccctaactgcgcagcgaaactaatattctccttatgactcttaatatgcacagcgacgctgacaaacagagccagagccatctcatcaagaggttgcagtcgcatatgtttaagcagagcctggcggagagcgtcatgtccttcacatatcattacgccatatggcggcgccattcttttcaactcagcccgccaggcgcgaccgttgactcgtttaccatccttgcgctcataacgctcagacagcgtagcaaaccagtcaagtagtgccttctgcgcatcggggtggagaattctgcataacactgctgtattgctattcagcatatttggcttccttctgttattcgaccagcgccaacacatccttgcgcgctttatgtttacgatagctgctggctaaatcctgtcgggccgtcagctggcgctgcaggatatcgtccgggcagtcggggttggtcagggcatcacggtcaaaaacgtgaaatagatagtgtgctaattccgcctcccactgacttactgcgtgacgagtctgtgtatcctgccgaagcggatcgacagccagcgcctcttgcaacgtccgaaaagcgggttcggtttcctgccagaaggcgatatccaccatactaaaatccattttggcttctttcggacaatcgaatttggcgctctttaacgcgttccgtaacagcgacagcgactcactagccagcaccagcacaatgttaagcgcagcgagaaattgctcttcgtgcgaaacgctaatgagcggaattcggtgctgataccagcagcggaccttggccttattcatatcccaggcaaagcaccacaggctcattttgttccgctgaccagcggcacgaacgacctttgcaggctgcattttgttgaacttatcctcacgattgagcatcagccccaaccagtctttataacttaacccgcccggctgccctttaaacgccagccagggtgcggatggatctttcaatgcctgccgatatggggagaagggatgtagccaactgtcgtactgaacgccataatttttactacgcatttgcagtagcagtgattcgtgatgctccccgcacaaatcgcagatacctgccacagtgtgggtgaaatccagttctatgcgccgcggcatcccccagtaggcttgcaaggggtgcgcattatccggtgtgaccacattccccgctttttcgctggttttcgtcggcgcaagccagggaaaaatgagtggatgctgtgtaacattcggcggctcttcctgcggcaaaacgttaagccaaagttttttccatagtggatatttatcttcttcctgcggtaccaccagcgtagtcagcggaccaccgccgcgcatccctacccggtaacccgccccgccggcaggtgaattggtttgaatcgcaaatagcgctatcgccgcgcagtgaggacatatttgttctacgttgccacgttttacaaaatgatctttattgagcttgagcgcattcccgcccggcgcatccaccagcagcccggcaatagaaccatattcactatcgagaggatcaaaactttgcaggaaggaaggtttttgctcgccgaactgtagagccagagaaatcgtatttaacgccttctcccattgttcgaattcgatactttcatgccagatatctgcccattcttctttatcttccggcgcgacggtacattgtaaaataccaatcagcatttgccatgccgccccctgaaagtcagcccgaggataggcaagatcctgaatgcggttatccagaagatcgcgtaatgatattttctttttatcgccgtttgagaatatgacgggaagccatttctctttggttaaatccatacctttactcctgcagggctatttattaagccaatttggaatattacctacctataggtagattccgtcctgaggtatctcttaaatactgtcatcggagttatactacattttctcgaagacgaaaatataaataaaaagtagatacagtcttaaatcagactatgtattttttatagttatctgttatctttaatacgttccctaaaattatgggataaaccgtagatgcagtcttaatagcgcagcgttccccgcgccagtggggataacctaatccagacaaaaaaactggccaattacccgtatcccaatttattatcgatttcattgtaatccccctcctacagaaaaaagatgacacagatagaatatctggactacctctgctattgggggaaaacagataaatcaacagaaaacataacctgtaattatcatttactggcataccattgcctggacgttgctgcatgcggggaatacataataaaaaacaatacattcaattcatgtaatatattaaaagaatgtaatatctcaggtacaaatgcagaaaactggataatctggtttcttgccagccacgatatcggaaaattcgccagaggatttcaaaaatacgccgaattcccagactctcccttagtctctcccattagcggtgtttccgcatttgagagacatgattccttaggcttctatttatggggtaaattatttgaagcgtggagttcaggtagtaatgaaattatcgcaggcattgaaccagaaaatcgcgctaggtttgaaagcgctttaaatagctggatgcttattagcaccgggcaccatggcatcccgccggacaccatgaaaaatagaagctcgctggcattcaccgatgaagacattgtcgcagcaacgcattatctggaagcattaagtgaattattccctttcactctacctcaggaatggaaaaccaaagcagggagaaaatgtttaaaacagcacagttggtttttcgctgggcttgtcaccctcgccgactggatgggctcggatgaaagccagtttccactgctcagcagcgccatgccattgaaagattattggcctctcgcttgtgaaaaagcccaacaggccatcctccgaatgccgccgttatctcagcacagccattatcaagatcaccgggcattatttccgttcattcagacgctcacccctcttcagcaacgagcaagcgaactggatatttcagcacccggtgcacagctggttgtcctggaagacgttaccggagcaggcaaaacagaggccgcactgattctgactcaccgcttaatgtcagccaataaaggccacggtctctacgttgggttgccgacaatggccaccgcaaacgccatgtatcagcgcctggcatcggcttatcatgcgctatttaccgatgagtccaggccatcgctcatcctggcacacggtgggcgagaaatgtcggactctttccgacaatccatctggcagccaacagaaaatatagctgaagattatgcccgtgatgatggcaacgcgactactgagtgccatacctggtttgcagattcacgcaaaaaagcgctgctggcggaagtcggcgtaggtacgctggatcaactcttaatggcggtgatgccttttcgccatcaatcgctccgattgctagggatgcgcgacaaaatcctgctgctggatgaagtgcacgcctatgatggttatatggttaaattgctggaaggtttattgcgcttccatgccgcccagggcggtagcgctattattctgagcgccactcttcccgccgctttacgggaaaaattacttaatgcgtttagcgatggcgcggaatttatgagcgctggtggtagcgataacgcgggttatccatggttaagccacctcacttcctccggtctgttagagcaaccactggccacacgtcccgaagtccaaaggactgtagccgttaattggatacagcagcgccaggaagcactggacattatttatcgcgttgtggcaaccggacagtgcatttgttggatccgcaacacggttgatgatgcgctggacacttaccagcagttgctacacgagggaatcgttccagagcaggatcttttgcttttccacagccgttttgcttttatcgatcgtattgctattgaaaataaaacgttaaactggtttggtaacaatgcccccgtttctgaacgacgtggtaaggtattaatcgccacacaagtcgttgaacaaagtctcgatctggactttgactggatgatcaccgatctggcgccgattgatttattgatccagcgcgccggtcgcctgcaacgccatatccgcgatgcccatgggcaacgaaaatctacgcttccggatgaacgccagccaccagtattgcatatttctggcccctcactggcaggagcaggcagaagagggctggttggggcaagagctaaaaggtaccggctttgtttacaccgatcatgcctgcctgtggcgtacccaggcgctgctgcgtcaacatggtgagatccgtatgccggataatgccagagcactcgttgacggcgtatacgagcagaaaattgctgcgccagcaggcttgcagacgatctctgacgttgcctttggcaaagtccttagccaacgttcagtggctgcgcaaaatttattacgttacgatctcggttacgatcgagaagccagcgactttttatgggataaagatagagaattttctacccgtctgggtgaagagagtgttgatgtttatctcgccagaaaagacattgatggacagctacgccctttagttgatgaaatagatttctgctgggaaaaaagtcgcttatccgtccgaaaatcatggtggcaaaaaaattctggtacattccaatgtccagatgaggaaacattagcctgtttcagaaaacgccaccatcgcccttccggacagattgtgctggtatctgataccggagaagctagctattacagtaaacgttttggattggttggataacgggtattattctaactccgttgtatagagaagttattacattagattcactaaaatctttgtagcttctctatctatatccatttccatgaatacccttaattaaatttaactacttcatttcatcatactttatctctcagcatcaacaccatccatgacaaaccaaaattttaaaaaaacgaccatttgcggcgaatcatctaccttttgtctgaattatcgtcaccacaaaggattaccaaccataaatgtgctgtattgataatgccgttcacattctctcctgtagtaaaccttgtctgtttaataaaaaagagcgaattgaacgatatattttactccggatattgaataatataaatttgaaggaaaatattatgccagtcactttaagcttcggtaatcatcaaaattatacgcttaatgaaagtcggcttgctcatctgttaagcgcagataaagaaaaagcaatccatatggggggctgggataaagtccaggatcattttagagcggaaaaaaaggaccatgcgctggaagtgttacactccatcattcacgggcagggccgtggtgaacctggagagatggaagttaacgtagaggatatcaataaaatttacgcctttaaacggctacaacatctggcctgcccggctcatcaggatctgtttactatcaagatggacgcttctcagacacaatttttacttatggtcggcgacacggtgatcagccaaagcaatattaaggacatcctcaatatatcagatgatgcagtgatagaatctatgagtagagaagagagacagttatttttacaaatatgcgaggtgattggtgcgaagatgacctggcacccggaattacttcaggagtcgatttctactctacgaaaagaagtgacgggcaatgcacaaatcaaagcggcggtttatgagatgatgcgtcccgcagaggctccagaccacccgcttgtcgaatggcaggactcgcttactgaagatgaaaaatcgatgctggcctgtattaatgccggtaactttgagcctacaactcagttttgcaaaataggttatcaggaggtacaaggtgaagtcgcttttagcatgatgcatccgtgcatctcctatttactacatacctattcaccgtttgcagagtttaaaccaacaaattccggttttttaaaaaaacttaatcaggattataacgactaccatgcaaaaaaaatgtttattgatgtaattcttgaaaagctatatctaacgcatgaacgttctttgcacattggtaaagatgggtgcagtcgtaatatattactgacataaagatagccagtaatataaccaatttaaaatccggctgcctgccggattttacatagcagcaagtataatcataccgcgtaaggacaattacccttcatgcagcccgcactcacgtttcagtccgaagaagcgtgtctcttcttccgccatacccggctcccatttgcgggtggtgtgcgtatcgcccaccgacagatagccctgagcccacagcggatggtatttcagaccgtgcttttgcagatactggtaaaccgtgcggttatcccagtcgataatcggtagcactttaaacacgccgcgctggatagcgagaacgggtaaatgcgcgcggctaccggactgctcgcgacgcagacccgcaaaccaggtctgcgcgtttaactctttgagcgcccggttcatcggctcgactttgttgatctcattgtatttctcaatgccctcaacgccctgctcccacagcttgccgtagcgcgcttcctgccaggccggactttcgcccgcgcggtaaactttcaggttgagtttgagtttgtccgttagctcatcaataaactgataggtttccgggaacaaatagccggtatcggtgaggatcaccgggatatccgggcgaatctggttcaccaggtgcaggctcaccgccgcctggataccaaagcttgaggagagcacgtattcgccgggcagattttccagcgcccaagccacgcgttcttcggcagtcagcgtttccagttgagcgttggtttccgccaacgccagtacgcgatcgacttttggcagttcattcaatgcgttgagatcgagttgggacataagttcctcactgtttgccttgcctgatggcgctgtgcttatcaggcctacacagacgccatccggcaattcaggttattcccagaaatcacgcgcgggatcgagcaccgggcgaatgatgcccgcacgcaccgtaaagtcgccgaagccttcacccgcttcacgctctttcgcccagcgcccaatcagttcatccagcgaagcctgaatatccggctcggtgatattttcttgatacatccgtggaatacgactcccgatgcggttgccgccaagatgcaggttataacgaccaggcgctttccctactaagccaatttccgccagcatcgcgcgaccacagccgttcgggcagccggtcacgcgcatcacgatatgctcatcaggaatgccgtgtttttccagaatcgcttccactttgtcagtaaacgacggtaggaaacgctcggcttccgccatcgccagcgggcaggtcgggaacgacacgcaggccattgagttttcacgctgcgcgctcaccgcattcatcagcccatgatcgcgcgccagtttctcgatcttcgctttctggctttccggcacgctggcaataatcaggttctggttagcggtaatacggaactcgccctgatgaatcttcgcgatctccagcaggccggttttcagcggacgccccggatagtccaggatacgaccgttttcgataaacagcgtcaggtgccatttatcatcaatgcctttcacccagccaatcctgtcgccacgcccggtaaattcatacggacgaatgggttcaaatgtgatccccgcgcgacgctcgacttccgctttaaacgtctccagtcccacacgctcaagggtgtatttggttttggcgtttttacggtcggtacggttaccccagtcgcgctgcgtagtcaccaccgcttccgccaccgccagggtgtgctccagcggcagatagccaaactcgctcgcggtacgagcgtaggttttcttattaccgtgctcaatagacagaccgccgcccaccagcaggttaaagccgaccagcttgccgttctcggcaatcgccacgaagttcatgtcgttggcgtgcagatcgatatcgttttgcggcgggatcactaccgtggttttgaacttacgcggcagataggtctgtccgaggatcggctcttcatcggtggtcgccaccttctcctgatcgagccagatctccgcatacgcacgagtgcgcggcagcagatgttcggagatcttcttcgcccattcgtaggcttccgcgtgcagctcggactcatacgggttagaggtacacagcacgttacggttcatatcgttggcggtcgccagcgcgtccagccccaccgaatgcagcatctggtgcaccggcttaacgttcttcttcagaataccgtggaactggaaggtctgacggttggtcagacggatactgccataaatcgtgttatccgccgcgaatttatcgatcgcctgccattgcgtcgtagtaatcaccccgcccggcaggcggcagcgcagcagcatggcgtggcgcggctccagcttctgcgccgcacgctcggcgcgaatatcgcggtcatcctgctgatacatgccatgaaagcgtattagcaggaagttgtcgcctttaaaaccgccggtgagaccgtcgttcagatcttccgcaatggtaccgcgcaggtagttgctttccagcttcatgcgctcggcatcggacagtttaccttcgaccaccagtgggcctggatatttttcgctcattagtagacatctcgctgataacggcgctctacgcgcagctcacttaaatattcatctgccgattcgaggtccataccgccgaattcagcgatcacttccagcaatgctttttcgacatctgcggccatgcgcctggcgtcgccgcagacataaatgtgggcgccatcattgatccagcgccacagctccgcgccctgttcacgcagcttgtcttgtacgtaaattttttctttttgatcgcgggaccaggcgagatcgatacggcttaacagtccctctttcacgtagcgctgccactccacctgatagaggaaatcttcggtaaagtgcgggttgccgaagaacagccagttcttgccttccgcgccatcggcggcacgctgttgcataaaggcgcggaacggcgcgatgccggtgccggggccaatcatgatcaccggcgtttgcgggttcgctggcaggcggaagttatcgttatgctcaataaagacgcgaacttcgccctcttcttccacgcggtcggcgaggaagctggaagcgccacccgcgcgggcgcggccttcgatatcatagcgaaccacgccaacggtgatatgcacttcactctccacttcagcctgtgcggaggcgatggagtacagacgcggcgtcagcgggcgcagcaggtcgattagcgcctgagcatccagctgcgccggagagaaacgcaccatatcaacgatcggcgtggtcgcggcgtaatgctggagctgcgctttgtcacccactaatggcaacagcgactcactgcgcgtcagggtcgcgtagttctcaacaatgttggcggtattcaccgtcagctcgaagtgccactccagcgcttcggcgagcggcagggttttaccatcaaccatcaccggctcatcgcctttcagccacagcaactcaaccagttccttcaccagagccggatcgttctgataccagacgcccagcgcatcgcccggctggtaacgcagaccggagtcgcctaaatcaatctcaatatgacgaacgtctttttccgagttgcgaccggtgattttctgattcacggagagggtcgcggtcagcggcgcgtctttggtataggggctggtgtggatgtcgtttaccgcgccagtagcgacggattgcgaaggtaccgcgacaggtgcacgggacttcagaacatcaaccacgcaggcgcgccattcgctggcagctgcctgatattcaacgtcagcatcgacacggtcgagcagacgctcaccgcccagttccgccagtttgctgtcgaaatcttttccggactggcagaaaaattcataagaggtgtcgccgaggctaaacacggcaaaagcggtgttttctagtttcggcgcttttttcgagaacaggaacttatgcagcgcgacagcctcttccggcggctcgccttctccctgggtggacgtcactatcaccaacagtttttcactggcaatctgtttgaatttgtagtcgccggcgttcaccagagtcacattaaggttggccgccagcagatcatcacgcagcgcttccgccacacgacgcgcattgccggtttgcgaagcggagataagcgtaactcccggcatcttcccatcaggagcaggcgtgacggcaacagcgcctgagcgcgggttcagtacgccccaaaaaaagccggagacccaggcaagctgttcgggagtaaggtcggttgtcgcggcctgaaggcgcgccagttgctccggattaagcggaagcaacccagtcagtggagccggtgtcgtcatgcgtcgttatgttccagtaagcaaagcggatctatacacaaaatcattcaagttcgctgtagcccagactgtaagctgatcgcgccccaggagcgtacataaatacgtgactggggcgagtaaacgcagtcaacacaaatgcggcttgaaggatgaagtgtataagcgataaatcccaaactaaggataagggtaacggtgagaggaataacaattaaagaagggttggaaataacaaataaccaaatgaactaacctgttttagttatcgttattaacgccaaaatcgatttcataattgattgataattattaaattttctggaaattcttaaattaattgcccgttacaaggcggagaatggttttagttaatgataaaaaatgcgctttccggtaccctacagcggtttttttattgcctgagagttcatcatgtccaccacgttgtataaagatttcacctttgaagccgctcaccgcctgcctcacgtgcctgaagggcataagtgcggccgcctgcacggacactcatttatggtgcgtctcgagattaccggtgaagtcgatccgcataccggttggattatggatttcgcggatctcaaagcggcgtttaaacctacttacgatcgtcttgatcactactatctgaatgatattccaggactgtccaatcccaccagcgaagtgctggcaaaatggatttgggatcaggttaagcccgtcgtgccgctactgagcgccgtgatggtgaaagagacctgtacagccggctgcgtctatcgcggcgaataaggtttattaacgcgtgggctggatggtaaattgattccagcctatccacacgacgttttatcagtgaaaacattgcccagcgcgcggtgttaaaagcgcagcacatcaccggttgcaggtgcggttatttccggtagccacaaccgcccccaggccccggtacagtgacaaccgcatagtttttcaggtttttgttcttgcagaaagcgcctgactcgccacagcgtgaacggtgatgcgcagcggagatgaaatccgccgataagcgcgtaaatccgctttataccggtaatgttctgacagtgccggacaatatttgcgatcccccgatgcccgcatcccataatgatgactaatccttttgtcgattggtaaatcagtacgccctcatccaaaatagagtccggctccgcatcgtggccgccaaaaatgccgtaggcttcaggcgcgaccaccggtatttcccctgaccagataaagttttcgccaatcggcagggggccacacgtgtacatcattcggtagcgtgaatagtccacctcacacgacaatttttttattttccgggtaataccgagaaaagttattgccgcataacgttcgcgcgcaatattgggatggcagatgattcgactgttatcaggaagccacggcacgccgccgcaatgatcgtaatgaccatgcgaaagcaccacagcagacacatcggacaggtcgatccccatcgccgacgcgttttgcataaaactgccatcagggccggtatcgaacaagatcgacgtagactcatcctcgaccaacaggcttaatcctggccgggccttcaacgatttatccgttccagctcccttatgattttcgagcaataccctgatccttaacgccatggccttctcctgtataaaagcctccccgggaaaacgcggcctttttactttacaggtttgtagcagccattactggtacacagattatgattatgcaacggctatccttgttgacgtggggaatactgctacacgcaaaaattccagtcgttggcgcacggtttatccccgctggcgcggggaacacactaaacgtatatcattgtttataaactactttttattagcaccacattctaccaacataatagcaacaatttaaattattaaagaacagctaatttgctgattttgatgcaaaaaagttcatagaatgattttttctttaaatttaccaaaataacgtgatccgtgcatcgctatggaaaaatttatcagcgcttttatacactcatcgaaattcacatagagaaaataaacaatgcaaggtaatggatgagtcacagacggcaacggcaggccgtccgtaagattaataatgcctcaggcgatatttaaatatttatgcgtttgcatagacagccgccagttacgcgcaatacacgtttcaatacacagacgcgtcgcgtcttctttctggctaatgggctgcaaagcaatcacgcgcggtttatcatcgctcaacgtggctaacagttcatccagcgcctcaatatcacgaactcgcccaacgggatgcttgatttcattggcgcgctccagcgcctgggaaagcacgtcatatcccccgcgcatattcacttttggtgaaaccgtgacccaggtattgggcgtacagcgcacttcgtgcgtcccgctggtttcaatctggcaactaaaaccactcttttcaagcagatcggtgagcggcatgaggtcgtgaatacagggttcgccaccggtgatgacaacgtgacgcgcggtatagccctgacgattaattactgccagcaagtcttcactgctcgcagcaccccatttgtcgctctctttggtttttgccagaatgctgaacagagacacttcccgatcgctcagtttatcccaggtatgcttagtatcacaccaggcacagccgaccggacatccctgtaaacgaataaaaatagcggggacgccggtaaaataaccctcgccttgtagggtctggaacatctcgttaatcgggtactgcatagcgttctctgttaaggggataatcgttaattattgcagatttcgtctgcccggtcatgcacagcggctgcgctattgaacagatacaaaaaaacccgccgaagcgggtttatacgttaagaggtaaaagcaggattacgcctggcctttgatctctttacgaccgttgtacggtgctttttcgcccagagcttcttcgatacgaatcagctggttgtatttagcaacacggtcagaacggctcatagaaccggttttgatctggcctgcagcggtaccaacagccaggtcagcaatggtagcgtcttcagtttcaccagaacggtgagagatgacagcagtgtagccagcgtctttcgccatcttgattgcagccagagtttcggtcagagaaccgatctggttgaatttgatcaggatggagttagcgatgcctttctcgatgccttctttcaggattttggtgttggttacgaacaggtcgtcaccaaccagctggattttgtcgcccagtactttggtctggtatgcaaaaccgtcccagtcagactcgtccagaccatcttcgatggaaacgatcgggtactgtttggtcagttcttccaggaagtgggtgaattcttcggaggtgaatgctttgttgccttcgccagccagaacgtatttaccgtctttgtagaattcagatgctgcgcagtccatcgccagggtgatgtctttacccagctcgtaaccagccgctttaaccgcttcagcgataacagccagcgcttcagcgttggaacccaggttcggcgcatagccgccttcgtcacccacagcggtgttcatgcctttgcctttcagcacttttgccaggtgatggaaaacttcagaacccatacggatggcttctttaaccgttttcgcgccaaccggctggatcatgaattcctggatgtcgacgttgttgtcagcgtgctcgccgccgttgatgatgttcatcatcggaaccggcatggagtatttgcccggcgtgccgttcagttcagcaatgtgctcgtacagcggcatacctttagcggcagcagcagctttggcgttagccagagagacagccagaatggcgtttgcaccgaagttagatttgttttcagtaccgtccaggtcgatcatgattttgtcgatgccagcctggtctttagcgtctttgccaagaatagcctgagcgatcgggccgttaaccgcgccaacagctttggttacgcctttacccaggaaacgggatttgtcgccatcgcgcagttccagcgcttcgcgggaaccagtagaagcacctgacggagccgccgccatacctacgaaaccaccttccaggtgtacttcagcttcaacagtcgggttaccacgggagtcgatgatttcacgaccgatgactttaacgattttggacattaggttttcctcaagtcactagttaaactaaaacttcagacaaacggtgcaccgctgagggtgcaccgccgttctaacttttttacttcgcctgacgtttctgatgctcgttggcggctttaacaaagccggcgaacaacggatgtccatcacgcggcgtggaagtaaattccggatggaactgacaggccacgaaccacggatgattcggtacctcaatgatctcgactaactgatcatcaccggaacggcctgcgacacgcagacccgctgcttcaatttgtttcaacaacatattgttgacttcgtaacgatggcgatgacgttcaacaatcgtcgacgcgccgtacaactgacgtaccaggctgtcatcgctaagctggcactgctgcgcgcccaggcgcatggtgccgcccagatcgcttttctcgctacggacttcaacgttaccgtcttcatcgcgccactcggtaattaacgccacaaccgggtacttacagtctggcacaaattccgttgagttggcgttgtccatgccggccacgttacgagcgaactcaatcaacgcaacctgcatccccaggcaaatgcccagataaggaatattgttttcacgcgcatagcgcgcagtggcgattttaccttcaacgccacgatagccgaagccgccggggatcaggatagcgtccaaatctttcagaatttcgacgccgcgcgtttcaacatcttgcgaatcgatcaatttgatgttgacggtaacgcggtttttcagaccaccgtgtttcagcgcttcgatcaccgacttataggcatccggcagttcaatatatttgccgaccatgccgatagtcacttcgcctgccgggttcgcttcttcgtaaatgacctgttcccattcagacaggttagcttccggacagttcaagctgaatcgtttacaaatataatcatcaagcccctgagatttcaacaggcctggaattttataaatggaatcgacatctttcattgaaataacggctttttccggcacattacagaacaatgcaatttttgcacgctcgttggcaggaaccgcacggtcggaacgacaaatcagaatatcgggctgaataccgatagacagcagctctttcacggagtgctgagtcggtttagttttcacttcgcccgcagccgccaggtaaggtaccagcgtcaggtgcataaacagcgcgtgttcacgaccgatatctaccgccaattgacgaatcgcctcaagaaacggcagcgattcgatatcaccgacggtaccgccgatttccaccagcaccacatcgtggccttcgccaccttccagcacgcgctctttaatcgcgttagtgatgtgagggatgacctgtacggttgcgcccagatagtcgccacggcgttctttacgcagaacgtcggagtagatacggccagtcgtgaagttgttgcggcgagacatcttggtgcggatgaaacgctcgtagtgccccaggtccaggtcggtttcagcgccgtcttcagtaacgaacacttccccgtgttggattgggctcatagtacccggatcgacgttgatgtacggatccagtttcatgatggtcacgttgagaccacgggcttccagaatggctgcgagggaggctgcggcaatgcctttacccagagaggatacgaccccgccggtcacaaaaatatagttcgttgtcatgcggaacctgagaagttaggtttaaaagacgatggaataaccaggacgggaaagcagtatacccgaacatgacctacgccacaaactttcattattcctcctcttcgccaggctgacattcacacagggagggagaaaatagcccctttgaggtaaatgtttttgacgtaaatcaagcgcttgttatttaaaaaatcacacaaatcgctcttgaccgcctaaaacctttagagatcaatttcctggcgttttacttcctgccaaacttcttccattgtttccaggtctaccccggtcatttccaggcctctggctgcgacaatacgttcaacttcgcgaaaacgacgttcaaatttatcgttcgctttttgcaaagcgatctccgctttcgtacctaaatgacgcgccatgttgaccgtggcaaagagcaaatcgcccatttcctcttccagtttagcctgatcaacaaccgcctgccgcgcctcgaacatcacctcatcgatctcttcatagaccttatcgacgaccggccccagcgtcgtccagtcgaagcccacgtttgaacaccgtttctggattttttgcgcgcgcattaaggccggtaagctgcgcggaatatcgtccagcgcggaatgctgcgctttttgcgcgcgctcttccgttttgatttgctcccagcgaactaatgcttcttcgctattatccgcggaaagctcgccaaaaacatgcggatggcggcgctccagcttgtcgctgatggcagcgcaaatatcattaaaatcgaagcggccttcttcctgcgccatctgcgcgtaaaacaccacctggaacaacaggtcgcccagttcgccgcgcaaatcgtcaaaatcctcacgcgcaatcgcatccagtacttcataggtttcttccagtgtataaggcgcgatgctggcgaaggtctgctctttatcccacgggcagccgttttccgggtcgcgcaggcgctgcatgagggtgagaagacggtcaatttgatggttagttgtcatggtctttaatcggttgtaaatactagcgacaattgtaacgtattattcttaaccattcacgcacagagacactacgacaacgcctatataataaaatatattgttaacaggtgttgaatgctacctttcccgtataactttaaaattattaatcgatacacaacaatataataatcatataactaatttattaaaaaaaaacagatatttgcactaggcattataaataacatcaattaagtaaaaaaattatgcaaacactataagccccccacccaaaagagccttccctttcaaaaaaaaataaattatttcacttttacggaaaaacgagtagcatgcacgccagtttaatattcaaaaaagaccgcttttttgttttttctgaaacatacatgaaataaatatattgaaagtattacatataatattctatgaacctgtacgaccattctgttcataagaatatactcataaaaatgtagaaatataatattttattattacatattttttacccaaagcccgcagcatggctctatgccgcatatcccttgatatacgcgtacaaaatgctgccataaaacacgttaattaaggataacacgatgaagtcatctcatttttgtaaactggcagtaactgcatctttagttatgggaattgtctccggcgctcaagccgcgggtagcaacacagcaaaggttactttccttggtaatattgttgattccccctgctctgtcacattggatacggaagatcaaacagtcaatatgggctcaagtatcggtaatggcacgctgagtaatggtaaaacgaccatcaacaatgcccgtacctttcatatcgatcttgagggttgtacctaggctaccgagaaaaatatgaatgtggtattcactacaggtagtggaaccacagcggctacaggcgccacggataatctcgcgctgatgaagactgacggcactggcgctattagcaacataagcctggcaatcggcgatgcaggcaaaaacaatatcaaactgggcgatacctatacacaggccattgcggacctggacagagataccatccttgatgagaagcaaagcctgaatttcaccgcctggctggttggcgcagcaaccggcaccgtaggcacaggtgaattcagcagcgccgccaacgtcactatctcttacctgtaattcagataacagagtcacgacgataaataccctgccgctttaggtagggtattcctgttgagttttattgcggaatatatttgatgaataacacatggaaaagtgttctttgcccaatagcgtgtggagtgggaatgcttctaagcgcctccccttatagcgcgtcaggcaaagacatcgaatttaataccgatttcctcgatgtaaaaaatcgcgataacgtcaacattgcacagttttctcgtaagggttttatcctgccaggcgtctaccttttacaaattaaaattaacggacagactctgccgcaggaatttcctgttaactgggttattccagaacatgatccacaaggaagtgaggtttgcgcagaaccagaattagttacgcaattgggtataaagccggaactcgcggaaaaactcgtctggataacgcacggtgaacgacaatgtctggcgccagattcactgaaaggcatggattttcaggctgacctgggacactccacgctgctggtgaatttaccccaggcgtatatggaatacagcgatgtcgactgggacccacccgcccgctgggataatggtattcccggcatcattctggattacaacattaataatcagctccgccacgatcaagaaagcggcagcgaagagcaaagcatcagcggcaacgggacgttaggcgcgaacctgggcgcatggcgactacgggccgactggcaggccagctacgaccatcgtgacgatgacgagagcacttccaccctccacgatcagagctggagccgctactacgcctatcgcgcactaccgacgctcggggccaaacttacgctgggcgaaagctatctccagtccgatgttttcgacagctttaactatatcggtgccagcgtcgtttctgacgatcagatgctgccgccgaaactgcgcggctatgcgccggagatcgtgggcattgcgcgctctaatgcaaaagtcaaagtctcctggcaggggcgcgtactgtatgaaacgcaggtgcccgcaggaccgttccgtattcaggatctcaaccagtccgtttccggtacgttgcacgtcaccgtggaagagcagaacggtcagacccaggagtttgacgttaacaccgcatcggttcccttcctgacgcgccccggcatggtgcgctacaagatggcgctgggccgcccgcaggactgggatcatcaccctattaccggcacattcgcctcggcggaggcttcgtggggggtcaccaacggctggtcgctctatggcggcgcaattggagaaagcaactatcaggccgtggcgctgggaagcggtaaggatcttggcgtggtgggcgcggtggcggtggacattacgcactccatcgcccacatgccgcaagacgacgggtttgacggcgaaacgctgcagggtaactcatatcgcatcagctactcccgtgactttgatgaaatcgacagccgactaacctttgccggataccgcttctcagaaaagaactttatgagcatgagcgactatctggatgcgaaaacctatcatcatctcaatgccggtcacgaaaaagaacgctatacggtcacctataaccagaacttccgtgaacagggcatgagcgcctatttcagctactcacgcagtaccttctgggacagcccggatcagagtaactataacctgtctctttcctggtacttcgacttagggtcgataaaaaatctcagtgcgtcgctgaacggctatcgcagcgaatataacggtgataaagatgatggcgtctatatctcgctgtctgttccctggggcaatgattccatcagctacaacggtacgtttaacggtagtcaacaccgtaatcagctcggctattccggccacagccagaacggcgataactggcagcttcacgtcgggcaggatgaacaaagcgcgcaggcagacggttattacagccatcagggcgcgctgacggacatcgatctgagcgcggattatgaagaaggatcgtaccgttcgctgagtatgtcgctgcgcggcggcatgacgctgaccacccagggcggcgcgctacaccggggaagtttagcgggcagcacacgtttgctggttgataccgacggcattgcggacgtccccgttagcggtaacggctcgccaacctcaaccaacattttcggcaaggccgtgattgcggatgtcggaagctattcgcgcagcctggcgcgtatcgatctgaacaaattgccggagaaggcggaagctactaagtcggttgtgcagatcacgctcaccgaaggcgccatcggctaccgtcactttgacgtggtcagcggcgagaaaatgatggcggttttccggctagcagacggcgacttcccacctttcggcgccgaagtgaaaaacgagcgccagcagcagttgggcctggtggccgatgacggcaacgcctggctggcgggcgtaaaagccggggaaacattgaaagtcttctgggatggcacggcgcagtgtgaagcatcactcccgcccacgtttacaccagagctattggccaacgcgctattgctgccgtgcaaaatgctggaaggtcagccccccaccgcaccgcagaaaagttctccgctgcctgcgcaaccgctaatccaggaacatacgcaaaccgatggccaaccggccgcgccggtggcgacaaccactcaaaccccgcccataccgctggctgacaaccatgcggtgaatcgcaaggatatggaataaagggaacctgtaatgaacaagaccaaccattttaatcgccaggcgcttattgccacggtattactggctgcgccgctggtgtcacacagcgcgattgtgccggatcgtacccgcgttatttttaacggcaatgaaaattcaatcaccgtcacgctgaaaaacggcaacgccactctgccctatctcgctcaggcgtggctggaagacgataagttcgccaaagatacccgctattttaccgccctgccgccgctgcagcgtattgagccaaaatccgacgggcaggttaaagtccagccgttaccagccgcggctggcctaccgcaggaccgggaaagtctgttttatttcaacgtgcgagaaattccgccgaaaagcgataagcctaatacgctccagctggcgctgcaaacgcgtattaagtttttctaccgcccggtagccgtagcccggcaggtggataagacgcacccgtggcagacgaagctcacgctgacctaccagggcgatggtgtgatcttcgacaaccccacaccgttttacctcgtcatcagcaatgccggtagcaaagagaacgagaccgcctccggctttaaaaacctgctgattgccccgcgtgaaaaagtgacctctcccatcaaaggtgcctcgctcggcagctcaccggtggtgggctacgtcgatgattacggcggccatcgcctgctggtttttacctgctcagggaatacctgcaaggtcaatgaggaaaaaacccgtgacgctgagaagaaagcgaataagtaatcctgtgcgaaagagatctatgacgatgttgactcgctggaaaatactggtgctgctgtgcggtggattcgttaccggcaccgaggctgccggcacaaaaaccgtgcaactggagctgcatctggtcgtcactcaaccaccgccctgtacggtaggcggcgcttccgtagagtttggcgatgtcctgaccaccaaagttggcgatgtttctcaaacgaaacctgtgggctacagcctgaactgcgatggcagagcgagtgactatctgaagctacaaattcaggggaccaccaccaccatcagcggggagcaggttctgcaaacttcggtgcaggggttaggcatccgtattcagcaggcgggcaataagcaactggttccggttggcataacggattggctgaacttcaccctgagcggcagcaatgggccggagctggaagccgtaccggttaaagagcccaccacgcagttagcgggtggcgattttaacgccagtgcgacgttagtcgtggattaccagtgatggagagattcatagtgaaaagggtgcttatcctgacgcttttaatcacccggtttgcctgcgccgacaatttgacctttcacggcaaactgataaacccgcccgcctgtactatcaataatggtgaaacgctggaggtcagttttggtagcgtgattattgataatattgacggcgtcaattacctgaccgagatcccgtggacccttacctgcgacagcagctttcgcgatgacgcattaacttttacgttgagctatctgggcacggcgacgccttactccgcaaaagccttaaccaccaatgtccctgggctgggcattgaacttcagcagaacggcacggtgtttcctcccggcacgtcgctaaccatcaatgagtcatcgcttcccacactaaaagccgtgccggtaaaacagcccggtaaagagcctgccgaaggcgattttgaagcttttgccacgttacaggtggattaccaatgaaccgtatttttcaaactaccgggcatttgatcggaggcgtaatgttatgggcggtttgcaatacgctacctgctgccacgcctaatgtgcactacagcggtaagctggttgccggagcctgtaacctggtagtggataatgacacgatggcgacggtggattttcatactattggcagtgacaatttcgacgccagcgggcaaacgactcctgttccattcacacttagcctccaggattgcaaaacagcgctagccaacggcgtggtggtgacctttcagggtgttgaagacagtaccctgcccggactgctggcgctcgaatcgtcttctattgctaacggttttgctatagggattgagaccgcagatcagcacccgttaattatcaacgcttctcaaggtacggaatttatgttggcagagggaaataccattatcaatctccaggcatggctacaaaaaacatcaggggaaaatattatgcctggggaatttaacgccagcgcaatggttaattttgaataccaataatgttatttaacaaaaaggcattgatgctctggccagaataaaaaggagttacaacgcaatggaaataaaaaaaagcatcttggttagaaaaaatatacgcttgtcaggaatcatcattgacatgctcattttaaccatacttttaatcagcacgtttgatgctgtatctgactcttccccggtaaaagcaagcgctatcaatattgcacttcaaggaactcccaacacagattatgaattaaatggcgatctccgctctaacggagggataatgccaaagacgctttatatggtatgttcaggaggaaaattcagtgcaagccaggctgattgcgttgccggtcaatgggtagatatcgaagttgtaatatctgcggacagtcatacgttcatgaatttgacaaatatgggcaatttgagttcttctgcatttcaggaaaaaaggcgtgctcgctgtacagcgaaaaatagtaatacgatggattgtatttgggaaagtaacttcgacattaacttgtttttttcaccttctacaaacatctcctcaattgaaagacaatctctgactctccatatcgagcctacgaataatgcatcaccttctctacagcaaatcaatatcagcggcgacttaatctaccagccttctgactacgcagtgtataatcaaggatatactcctgacgtcttagcctacgttaatttttatgctaaatacaatatcgtccaatcaagctttggtacacagacaggcccggcgacgggcgccctgccgggacgcctcaatctgaacgggaacgtagcgaccacagtttctttatatcctgaacaacttgatgcctctttttcgaaaacagaattttccatcacatctgccagcaaagaatttacgggttctggtaataatgaactactggcagaaatctatctaaactatggactacagcattgccagccgcaaacggcagatagtatttgtggtcaaatattagctaacgcgaacgtttcaacatcgtgtggtgatcataatattactatcacaaccaatatgtgcaatacaggtaatgaccaatgtgatagtgatgaaacatggaaaattgcagagatcttcgggacatggggccgggttaatgtcgacactatatgcgctattacagtattgcttccctatgaataatgcttagaaaaaatactcggaaccctaaataatctcgcaaaacagtagattacttatccgaaaaatttttcggccttcagtgaggggctctgctccagttgcgcgatcagatcatttaaccaaaataatagtcgaacaaaagaggcgagccatgaacggctaccatttctttcgcgagttaagcgaagaatgctgaaaaaacagtacagaaaagtcaggataaagagttatacagacggcttaccactatcccaatgctgtatacaggattattggttagttcactttactgctcctaaaaaacctgcctcacttaaaatttagcaaaattattgaccaaggaaaacaaatgtgtacaaattttttaaaaacatcgctactaataacatccactttttggtgtattgcgctacaatgcgctgaagtaagaacggatataaaatataattctcaaattatttcacagtttgatagtattagcgcactggctggcgatcctacattcgataccatccataccccattaccaacaaacattcatatcctttcatcgtgcactaagtcaggtggagggggggttgtattccaggtacattgcctgatggacttgaatccactcttgagtttgatccatcaacttctttcatcaatacaaccgctgtcgataacggtatcacttatagttttactggtgaagcggtaaaagcgacggcacatgccagctgtacggctaatcaggcaactaacagcgcaatttgtgtatgggataaatcattttcacttcccctcaccttacttaccaaacagaacggaataaccattaaccagcaaaatcttacagtttcggtaatacccggaggaggaaataatgatactaaccagtactcatccctttccggccatattattattgatgaatcggtaagcagctacacgaattatgaaccggaaacatcgggcattgagaatttaaaattaaaatggactgtaacagtgacagaagataccgaaggtgatgtcggtatatggaacggatcacttgtacttaatggctctccagcgtccaccctacatcgttatttgcttccagaaatattagatgcttcattttctgaaaatgcgatagcgcacagtaccgaagtcgccatgactggcgcaaaaaataatgtcgagctagcctctgtatatctctaccatggcaatacgccatgcgatgatacatccttgtgtaactacagtcttaataagacatcagtttctcttgtatgtcacgatctgaatgcgcaacttaactttagcaacacttgtaatgcttcaggcacaacacattgcctgaacggaaaagtaggtacgataaagggtacctgggagagagtcaacatcgatacaacttgtgcaattaccgttttgataccctacgaataaacacaggaaaaatgatgaccataagcaaaagaatcataatttcatttattctatttatgtgcttcaccaacaatacatttggatctggatacgttaagatcaatgccgaattgaatgatatggcaggcagaggggtaggcacagtgatttaaatagtaatctacggcgaaggggaaatctttctttttggttgtacagggaacgcttcggcataccagaaaggaggtcagcccctcacgggatagatgaaaaaacagatccagaatcgcagggcgaaaagagttaatgatgagaacagataaagaatgaagaagcttagatccagactcatagctaattattcatagaataaatactatagtaatgaataaaattcagaataggtgttacgtatttcaaacacataaaaccttaaccgatatcacatagagtataacttaaaaaggctataaccaatttacatgcttaccagcatcctgattctggctcagaatacgtatcacgataacttccgtaactgattatataaaatagataatatgcctttcaaacggtaaggcataaatgtattcacccagttcaggtcgaggcgtgccaatgttattggcactcataatgctgaatatttctgatagatgatgaatatatcgatcggcctgtatttcaccaaaatgctgccagccgtaatgccagatattttccagatcttcactggcctttggcgttaattttaccgttctcatcgggtttgatcatccctgttttgaccttccgtaaaaaggcatccttttcccaggcctgcggctctccgctgttcagaccttcagccagaagttcacgtaacgcctgaagtcgtgactcggcctgtttttccctcagcagacgaagagactctctgatcacttcactttgcgttctgtaatcacctgattctatgagcgattcaataaactcgcgcaattcatcgccaagatcaacggtcattgttctggccataacagcctccactgtaagtataaatcttacataagagtacacctgaaatgaaatgtacgtcaaaaacatacctcatatatcatgcttatggggttggctaatgcggctttgctgaacgagtagcaaagccgctacattattactgtctggggtttaccccccgtgcagtcgccgtgcatcaatcacatccggcacctggttcagcttaccgagcacgcggcccagcacctgcaggttgtagatctcgatggtcatatcaatggtggcgatctgctgtttaatgtcgctgcggctggcgacgcccagcacgttgactttttcgttagccagaatggtggtgatatcacgcaataaaccgctgcgatcgttggcctggacgcgcaccaccagcgaatatcccgccgagtagctttcgccccataccgcctctacgatccgctccggcgcatgggagcgcagttccgccagctgttcgcagtcggcccggtgcacggaaatcccccgcccctgagtaatgaagccgacaatttcatcccccggaatcggctggcagcagcgggcaatgtggtgcatcaggttaccaaccccttccaccaccacgcgcccgtcgtctttacgacgattttgcggcgcgtatgttttttgctgaagctgtttcagcgccgctgcatcctgctcctctgcactcggcttattgaactgcgattgcaggaaattcaccatctgattaagacggatatcgccgccgcctatcgccgccagcaactcttccagctcattaaagttgtagcgcggcagcagatgtttttcggcctctttcaggctaatccccaaatgcgccagctcatcgtcgaggatctgccgtccagccaggatatttttgtcacggtcctgtttacggaaccaggcgtgaattttcgagcgtccgcggctggtcgtcacatagcccaggtttggattcagccagtcgcggctgggattcggctgcttctgagtgataatttcaacctgatcgcccatctgtaactggtaggtaaacggtacgatgcgcccaccaattttcgcgccgatgcagcggtgcccgacatcgctgtggatgtggtaagcaaaatcgagcggcgtagatccggcaggcaagtcaaccacgtcgccttttggcgtaaaaacgtagacccgatcgtcaaacacctggctgcgcacttcatccagcatttcgccggaatcggccatctcttcctgccaggcgatcagcttacgcagccacgcaattctgtcttcatggccggaacgcacgccgccggacgcggcgccttctttatacttccagtgcgccgccacacccagttcggcgtcttcatgcatctgtttggtacggatctggatctcaacggttttaccgcccggccccaagaccacggtgtggatagactggtaaccgttcggtttcgggttagcgacataatcatcgaattcatccggcaggtggcgatagtgcgtatgcactatccccaacgcggcgtagcagtcttgcagacgttcagcgacgatacgcacggcgcgcacgtcaaagagttcatcaaacgccagatgctttttctgcattttgcgccagatgctataaatatgttttggtcgtccgtagacttccgcctgcacgccttcgtttttcatttcggcgcgcagatgtccaacaaactcttcgatgtaatgttcgcgatcgaggcggcgttcatgcagcagtttggcgatgcgtttgtattccgccggatgcaggtagcggaaacagtagtcttccagttcccacttcagttgcccgatgcccagacgattagcgagcggcgcatagatgttggtacattctttcgccgccagcacgcgctcatcttccggcgcctctttcacttcgcgcaaatgagcgattcgctcggccagtttgatgaccacgcagcggaaatcatccaccatcgccaataacattcgacggacgttatcaacctgctccgaagaaacagagtcgttatgagtggcgtttaactggcggatcgccgccatatcgcgcacgccatgaatcagggtaacgatagatttgccaacgctttcgcgcagtacatcttcgctgactacgttggcgtcggccagagggaacagtagcgccgcccgcagcgtgtcgatatccatactcagcgtggaaagaatttctaccatctccacgccacgccacagcaacagatccgcatccggatgtccttgtgtctgttgcaggcaatacgcccaggtttcggctaagcgctcacacgactgctggctggaaattcccaggcttgcgatccacttcttcggatcaaattcaccagctttattaatatgtgcacttcttaccgcgaccatcgtcctctccttaagggaccaggcctaccgaagtcggtaagccggtaatcattacatgcgctcgaacagaaccattgattccagatgtcctgtgtgcgggaacatgtcgagcatcgctaaacgcgtaacctcatatcccgcattgaccagcgcttcactatcgcgcgccagcgtcgccgggttacaggatacataaacaatgcgaataggttttaattttataatatgtcgcatcactcctgtagcccccgcacgcgcaggatcgagtaagactttgtcaaagccgtttttcgcccacggctgcttcgtgacatcttcctccaggttctcgtggaagaatgtcacattatgtaaaccattgcggatggcgttttcacggcctttttctaccagcgcctgaacgccctcaacccctaccacgcttgccgcgcgcgttgccagcggtagcgtaaaattccccattccgcagaacagatccaggacacgatcctcggcgcgcacatcaagccactccagcgcgcgggcgaccatttgctggtttaccgcctcattaacctgaataaagtctcgcggactgaaggttaaacgtaagccgtgcgaatcataccagggcgcttcgccagataccgtttccagtatctcgctaaacggcgccaggaacagagacaatccctcagaatgcgaaaagcgttccagtttttctttatccgccgcacttaatggcgcggtatggcgcagaatcatcagcgtaccgcttcccgcctgtaccagctcaacatgcccaagatgtcgggtgccgtgtaaactcgccagacacgccctgatgcggggcagcaatgcttcaagctggggcgccaaaacggggcactgttcgacattgacgatatcgctggaacccgctttgcgaaatcccatttgcagcggtttatccggcgggcaattcagacttaaccgcgcacgacgccgataaccccaggacgcgccggcgatgatgtcattcacctcatgtttcattaaacgcgccagcgccgcgcttttgctgcgttgttgcaggtcgatgccgacatgctgttgctgacaaccgccgcagacgccaaaatgcgggcagcgcggcgtttctcgttccgggctatcattcaaacggcgcgaaacgcgtgcgcgggcaaattgctttttatcttctgtaataatgacttctgcgctttcctcaggcaataaaccggggataaacagcgcctttccgttatgacgggctacgccctgaccaaatgaatcgaggtcattgactttaacggttatgatctgacgcgtcgtcacgcgccgttttgcagagtagaattgcgccatcgaccagctttttctcaatttaacagtgtgaccctaattgtcccataacggaactccatgaccaactacagcctgcgcgcacgcatgatgattctgatcctggccccgaccgtcctgataggtttgctgctcagtatcttttttgtagtgcaccgctataacgacctgcagcgtcaactggaagatgccggcgccagtattattgaaccgctcgccgtctccagcgaatatggtatgaacttacaaaaccgggagtctatcggccaacttatcagcgtcctgcaccgcagacactctgatattgtgcgggcgatttccgtttatgacgatcataaccgcctgtttgtaacgtctaatttccatctggacccctcacagatgcagcttcctgccggagcgccgtttccacgtcgtctgagcgttgatcgccacggcgatattatgattctgcgcaccccgattatctcggagagctattcgccggacgagtcagcgattgccgacgcgaaaaataccaaaaatatgctggggtatgtggcacttgaactggatctcaagtcggtcaggctacagcaatacaaagagatttttatctccagcgtgatgatgcttttttgtattggcattgcgctgatctttggctggcggcttatgcgcgatgtcaccgggcctatccgtaatatggtgaataccgttgaccgcattcgccgcggacaactggatagccgtgtggaaggatttatgctgggcgagctggacatgctgaaaaacggcattaattccatggcgatgtcgcttgccgcctatcacgaagagatgcagcataatatcgatcaggccacctcggacctgcgtgaaacccttgagcagatggaaatccaaaacgttgagctggatctggcgaaaaagcgcgcccaggaagcggcgcgtattaagtcggagttcctggcgaacatgtcgcacgaactgcgaacaccgctgaacggcgtcattggttttacccgcctgacattaaaaacggagctgaaccccacccagcgcgaccatctgaacaccattgagcgttccgcgaataatctgctggcaatcattaatgacgtgctcgacttctccaagctggaagccggtaagctcattctggaaagtatcccttttccactgcgcaacacgctggatgaagtggttacgctgctggcccactcgtcgcatgataaagggctggagttgacgttaaatattaaaaacgacgtcccggaaaatgtgattggcgacccgctgcgcctgcaacaggtcattactaatctggtgggcaatgccattaagttcaccgagagtggcaatatcgacattctggtagaaaagcgggcgctcagtaacaccaaagtacagattgaagtgcagatccgcgatacggggatcggcattccggagcgcgaccagtcgcgactgtttcaggcgtttcgccaggccgatgccagtatttctcgccgtcacggcggcaccgggcttgggctggtgattacgcaaaagctggtcaacgaaatgggcggggatatctctttccacagccagcctaatcgcggctcgaccttctggtttcatattaatcttgatcttaacccaaatgtcattattgacgggccgtcgaccgcgtgtctggccgggaaacggctggcttatatcgaaccgaatgctaccgccgcgcaatgtaccctggatctactgagcgacacgccggtggaagtgatttacagcccgaccttctccgcgctgccgttagcgcactacgatattatgattttgagcgttccggtgaccttccgcgagccgctcaccatgcagcatgaacgtctggcgaaagcagcgtcaatgacggactttctactgctggcgctaccttgccatgcgcaaattaatgccgaaaagctgaaacaaggaggcgcggcagcctgtctgttaaaaccattgacgtcaacgcgcctgttgccagcgctgacagaatattgccagttgaatcaccatcctgaaccgctgctaatggataccagtaaaatcaccatgacggttatggcggttgatgataatcccgctaatctgaagcttatcggcgcgttactggaagataaagtccagcacgtagagctttgtgatagcggacatcaggcggtggatcgggcgaaacaaatgcagtttgatctgattttgatggatattcagatgccggatatggacggcatacgcgcctgcgagttaattcaccagcttcctcatcagcagcaaacaccggttattgccgttacggcacatgcgatggccgggcaaaaagagaagttgctcagcgcgggcatgaacgactatctggctaaaccgatagaagaagagaagttgcataatctgttgctgcgctataaacccggcgccaacgtagcagcgcgcctgatggcgccggaaccggctgagtttatcttcaatccgaatgcgacgctcgactggcagcttgcgctccgccaggctgccggtaagcccgatctggcacgggatatgctgcaaatgctgattgattttctgccggaagtgcgcaacaaaattgaagaacaactggtgggagagaatcccaacggcctggtcgatctggtccataagctacacgggagctgcggctatagcggcgtaccgcggatgaagaacctttgccagcttattgagcaacagcttcgcagcggcgtccacgaagaggagctggagcctgagtttctggagctgctggatgagatggataatgtcgcgcgtgaagcgaagaagatattaggctgatattcgccggatggcggcgtaaccgccttatccggcctacaactcagcgtaattgttgccccgctttcagcgttgcagccacgttgcgcgcggtcattcgtacgttttcactcgcattcttcagcgcgtcctccaacgtgcagatggtataaatcacgctgaaaacggcatcaagcccatgttcatgaaccacgccaacgtccgccgtcaggctacccgcaataccaattaccggcttgttataccgtttggcgatgtttgccacgccaatagggactttaccgtgaatggtctgactgtcgatgcgtccctcgccggtgatgactaaatcagcatccgcaagacacgcttccagatgaagcgcatcggtgacaatctcaataccacgccgtagctgcgcgccgcaaaacgcgtataacgccgcccccatgccgcctgccgcgccgccgcctgccagatccaacacatcgacatgcagatcgcgggcaatcaaatgcgcatagcgagtcaatgccgtatctaggcgttcaatcatttccggcgtcgcccctttttgcggaccaaaaactgcagacgcgccctctttgccggtaaggggattcgtgacatcgcaggcgacctctatatggcacgccgacaaacgcttatccaggccgctgatatcaatgctggcgagtgtttccagcccaatgccgccttgcgcaatatcattgccctgcgcatcccgtagcctggcacccagcgcctgtaccatccccgcgccgccatcgttggtggcgctaccgccgataccaataatgatatgctcaacgcccgcatccagcgcatgacggatcagctcgccggttccccatgacgtggtcttcaacggatcgcgttgcgcgggcggcacctgctccagcccgctggcggccgccatttcaatgaacgcggaacgcgcatcgccggaaagcccataaaacgcattgacgcgatgccccaacggcccggtgacctcaacatgcacgattcgacccgccgtcgcttcaaccatcgcttcgacagtaccttctccgccatcagccagcggtaatttcaggtaatccgcgtcaggccagatctcgcgaaatccttgttcaatggcggtcgctacctcaagagcactcaaactttccttatacgaatctggtgcgatcactattttcataagtcgtccttacgcatgttgatcctgttaagcatacacccagagaaggaccggttccttacggaaccggctctgacttaacgcaccatgcaagggcgcttattatcaaacgtccagccaggaattaagtactgcattcccatcgcgtcgtcacgcgcgcctaagccatgcttttgatagagctcatgcgctttcatcacctgatccatatcgagctcaacgcccagccccggtttggtcggtacttgcaccatgccgcctttaatttcaaacggttctttagtcagacgttggttgccttcctgccagatccagtgggtatcgatagcagtgatcttgcccggcgccgccgcggcaacatgggtaaacatcgccagtgaaatatcaaagtggttgttagagtgcgagccccaagtcaggccgaactcatgacacatttgcgccacgcgtacagagccttgcatagtccagaagtgcgggtccgccagcgggatatcgacggattgcagcgacagcgtatgccccatctgacgccagtcggtggcgatcatattggtggccgtcggtaatccggtcgcgcgacggaattccgccatcacttcacgaccggaaaaaccctgctccgcgccgcacggatcttctgcataggccagagaaccttttaggtatttaccaatgctgatcgcttcgttcagcgaccaggcaccgtttggatcgagcgtgacgcgcgcttgtgggaaacgtttcgccagcgccacgattgactcggcctcttcttcgcccgccagcacgccgcctttcagtttgaagtcgttgaagccgtatttttcatacgccgcttccgccagacgcactaccgtttccggcgtcatcgcctcttcatggcgcagacgataccagtcgcattgctcatccggctggctttgatacggcagcggcgtaaccttgcgattgccgacaaagaacagataacccagcatttcgacttcgctgcgctgctgaccgtcgcctaacagcgaagcgacgttgacgcccagatgttggcccaaaaggtcaagcattgccgcttcaatgcccgtcaccacatggatagtggtacggagatcgaacgtttgtaaaccgcgtccgcccgcatcgcgatcggcaaactggttgcgaacggcggtcaggacatttttatattcatccagcgtttttcccaccaccagtggaatcgcatcttccagcgttttgcgaattttttcgccgcccggaatctcgccgaccccagtatgaccggagttatctttaacaatgacgatgttgcgcgtaaagaacggggcgtgcgcgccgctcaggttcatcagcatactgtcatgacccgcaaccgggataacctgcatttcagtcactacaggcgtggtaaattgagtactcataactgtgtccttattcagaattagtgacgaccaaaaacagggcgtttgcggtcaaaagtccagccggggatcaggtattgcatcgggcctgcatcattacgcgcgccgcctggcagctttttatacgcgtcatgcgcttttcgcacctgttcccagtcaagctctacgcccagtcctggcgcatccggaacggcaattttgccgtttttaatttccagcggatttttagtcaggcggcaatcgccctcctgccagatccagtgcgtatcaatagcggtgggtttgcctggcgccgccgcgccgacatgggtaaacatcgccagtgaaatatcaaaatggttattcgaatggcagccccaggttagcccccagtcatcgcacagttgcgccacgcgaacggcgccggtaagggtccagaaatgcgggtcggcaagaggaatatctaccgcgttgagcatcaccgcgtgtcccatttcacgccagttggtggcaatcatattggtcgccaccggcagtcctgtcgcgcggcggaactccgccatgacttcacgaccagagaatccttgctccgcgccgcacggatcttccgcgtaggtcagtacatcattcagccctttgcacaacgcaatggcttcatccagtagccaggcgccgttcggatccacggtaatacgcgcgtccgggaagcgtttttttagcgcgcgaacggtatcaatctcttgttcgcccggcagcacgccgcccttgagtttaaaatctttaaagccgtagcgatcctgagacgcttccgccagccgcacgaccgcgtcgctgttcagcgcttcctgatggcgcagacgataccattcatgactgcccggcgtgctttccagatacggcagatcggttttagtgcgatcgccaatatagaagagatagcccaacacggtgacggcatcgcgctgtttacctggccctaacagttcacagaccggcacattaagcgcctgtccctgtagatcaagcagcgccgcttccaaagccgccaccgcgttaacccgcagttcaaacgtccatgcgcctttgccaaaggtgtcaaaatcagcggcctggttgcctttatgcacctgctgcaccactttgttcaggcgggcgacttcctggcctaataccatcggaatagcatcgaccagcgtctgataaatcacttctccgcccggcgtctcgccgacgccagtatgcccggcgttatcggtgaggacgacgatgttacgggtgaagtacgcgttatgcgcgccgccgatgttgagtagcatactgtcatgtccggcaaccggaatgaccttcatgtccgtaataacgggactggattgcgttgtcatgataattgtcctgcgacaggtttcagttcaatacgcttaatatcgcctaccagcaccagatagctgatgatggccaccagggcatgtacgccgacatagatcaacgcgccgttgaaggaaccggtggtgccaacgatgtaaccaatcgcgattggcgtcacaataccggaaatattgccgaacatattaaacaagccgccggaaagaccgctgatctctttcggggcggtatccgccattactgcccagcccaacgcgccaatacctttaccgaagaaggccaacaccataaagccgatgatcatccattccacgttcacatagttacagaacaccataaccattgacagcaacattcccagcacaatcggcgtcttgcgcgcgatattcaggaagccagtacgacgcatcagccagtcggaaatgatgccgcccaacacgccgccgataaagccgcagactgcaggaaccgaggcgacaaagcccgctttgagaatcgacatgccgcgcgcctggaccaaatagaccgggaaccaggtaataaagaaataggtcaatgcgttaatacagtactgaccgatgtaaacgccaatcatcatacgagagcccagcagctgtttgatctggccccatttgacgctaaacggtactttcgctttggtgtctttctgatccatattgatcagcgcgccgccttctgcgatgtactccaattctttcttatttacgcccggatggttatttggttcatggataactttcaaccagataaagctgatgatgatccctaacccgcccataaagaagaagacatgcgaccagcccacttcgtgcgtcagccagcccataatcggcgcgaaaataaccgtggcaaagtattgcgcggagttaaagatggccaccgccgttcccctctcctgcgccgggaaccaggccgcaacgatgcgactgttgcccgggaaagaaggcgattccgccagaccgaccaggaaacgaagcgtaaagagggcgacaataatgccgaaaccactaaagatatcgacaaaaccctgcaacagggtgaagactgaccaaatgaaaatagaccagaaatagacgcgtttggaaccaaagcggtccagcagccagccgcccgggatctgcccgataacataggcccatgaaaaagcagaaaaaacatagcccatacctaccggatcaaggccgatatctttggccatttctgagccggcaatggacaatgtggcgcggtcgccgtagttgaaggatgtgacgataaacagcatcaccactatccagtagcgggcgttcgtgcgtttctccgcactgctcgccgcgtgacttaatgaactcattgttgcactcctgaaatttcgcgttagctacgctcactctgaactgcacaaccggtagggaatcagagataacgtttccttgttgcagcttttattaggtcgtttgctttgcacgctgcatgcttttattcactggcaggagaagtataaaaagcgcgccacacacactcaccgtgcaacaacacagtattttggcgatgaattacgcctgtttatggcaaaagcccaggacagtggaagccacttcacggaaatgaaatcagaaggcgtcggcgtcgacgcaggaggagtaaaaagagaagaatgtgaaacaggtcgcttgattacatgaaaacgcccgtaaaaaactgccgcttttgcgggcatatgcccaaagctaacacgattcagttactttacactgtgtacaggtcgtgattttgcttactggcaacgcaagcaaacgaaaaggtaccctcccgtaggggggagggatttacctcaggaaagtaaagttccccagttttcaacccagggattggattggctctccggctccggatgttcgctggcgtcaatgaataatatctcccccacccgctgcgcgctttgctcttgcaacagggcatcaaactgtttgccgccattacagaaattggggtagctgctatcacctagcgcaatcaccccgtaacgcaggtttggctgaaaacccaacgtatctttaatgccgtgaaagagcggcgcaatgctatccggtagatcgccttgcccggtcgtcgaggtaacgaccagcgcaaccttatcctgatattgctgccagtcggacagttcaggatcttcaaacacggtcgcgctgtggccctgtctggcgaggatcgcttccgcttcttccgccaccagcagtgagttgccatacatggtcccgacaaaaataccaatttccgccattatgcgtatctccctgaattatgtcagatgagtctcatcctgccgggacgccgccgtaaactcaaccctttcattgtcagggagaagtccacgccagccaaactgtgtcagcacctgcatccaggtttcatccaacccggcctgaattatcaacggctgtccggtgaaggggtgcgtcagttcaagccgactggcatgaagcatcaggcgacgacaggcaaaatgctctgcggcgctgcggttttgtcgcaaatcgccatgcttgctgtcgccgatgataggatgacgcagatgcgccagatgacgacgaagctggtgcttgcgtcccgtttttggttccagctcaaccaggccataacgcgtggtgggataacgcccggtcggcaccgccatttcgaccgtcgccagcccgcgatactgcgttacagccggctggggcgctttatcttcgcgggcgaatttatcggcaattttatcgcgctcttccaccagcggataatccagtaccgcgtcatctatcagccagccgcgcacaatggcatggtagcgtttacggatgtggtgctgctcgaactgctgcgccagacggcgtcccgcttcgctggacagccccattaacagtacgcccgacgtgggcctgtcgagacggtgggcggtaaaaacatgctggccgatttggtcgcgcaccgtttgcatgaccacgactttttcgtcgcgatccagccagctccggtgaacaagccagcctgcgggtttattcacggcaaccagccacgggtcttgatagaggatctccagcatcaggatttatcgcggacgaatagcgcatccagatcctgcaaaaccgccaggatcgcctcccgctgcggatgatccgccgccagcgccatttcataataaggggcgacggcaaacgcctcgggcagcggctgcgcattatcaagtagggtatgcatacgtgggatcaatacccattgcagccattccagcggttccatggtatccataaaaaatggttgggtgctggtaaacaaatgcgcctgcggcgcatccagccgccagtggcgatgctcgcgcagcagcgtttcaagcgcatgtaactgctgacgcacacggtcatgagtcgtcatgttaaaacctcaatgatgaaaatctggcgcgaagaataacaaaaaaagggagcactgtataaacagtgctcccggttcgtttcgcagcattccagctacttttcgtgctccctgctcatccgtgacaacttttcctgtgaccttacggcctgttcatcctgaacgtttacatcctgcgcacatcgcccgatgtgatagcttcatcctgaagcgtccctggttatccagatccgccgaacatcctgatcggctctcgttctccgtcctggaggtgtcctttaacgcatcctgcgctttccactttgcttcatcctgaagcctttccttgtaacaccatcctggcgtgtcctgctgaagcgtcatcatcctgacgttcgcttcgttgtacgactccctgtcgacgaagatagaatcgcctgtttcaccttgtcttacaagacgcttacagacaataccttaagtaaattttcatatgaaagtgcgcaaaaacattttaattagttgttttatatagacttacataagaaaacggggctcagtatccgctgatatcctggcgatctcctacagactttgtaagagatctctcacacccgttagggcaaacgattacagaagaggattaagttgcgtaaggaattccgcaagcgttgcggcaagaacggtacgattgcgggtgcccagcgtttctttaatcacctcgccggacagattacagaccgaaatgacctcaagctcattttcctgcgtcgcaataaaaagcgtgggaggaagcttgagccgcttttgcgtgaccaggtggcctatcagattttcctgcacgcgccgaaagtcatcctgactccaggtttgcagtagcgtaagcttttcatccgcaaactgcgcgggcatgtcgccagcaaactgcgtggtgtaaaacgcgtggagcgcaggttgtaccataatatcaaaggcgcgttcaaccgcgtttacattttcttcgccttcaaaaggctgcggctgccagtaaacggcatcgcgggttgaagaaataatgcacggagaaggtacgccatacagttcttcgctcaacggccagctaccgtgtttttcttgccacgcgtcgcagtaacgcgtcgtaaaggctttcaatgcctgcgctgtcagttcgtccaccagtttctctcttcataaaagccaggatacacttgacgcatagtgtatctggtttatgacggtgaaacatgtcttcttatgaaaaccatcaggctctcgatggcctgactctcggaaaatcaacggattaccgggacaattatgacgccagcctgctgcagggcgtaccgcgcagtttgaatcgcgacccgctcggattaacagccgataatttgccgttccacggcgcggatatctggacgttgtatgaactttcctggcttaacagccagggtcttccgcaggtcgccgtcggacatgtcgaactggattacaccagcgttaatttaatcgaatccaaaagttttaaactgtatctgaacagctttaaccagacgcgctttgacacctgggagacggtgcgccagacgctggagcgcgatctgcgcgcctgcgcgcagggcaacgttagcgtgaggcttcatcgtcttgatgagctggaaggacagcctgtcgcccatttccacggcacctgtattgacgatcaggatatcagtatcgacaactaccagtttactaccgactatctgcaacatgcggtcagcggcgagaagcaagtagaagaaacgctggtcagtcatctgttgaaatccaactgcctgatcacccaccaaccggactggggctcgatacaaattcagtatcgcgggcgcaaaatcgacagggaaaaactgctgcgttatctggtctccttccgtcaccataatgaatttcacgagcagtgcgtagagcgtattttcaatgacattctgcgcttctgccagccggaaacgttaagcgtttatgcacgctatacccgccgcggcgggctggacattaatccctggcgcagcaataccgattttgtgcccgccacgggcaggctggcgcgtcagtaatcttttttgtcaattttgcgtgccggattgcgcatgtaaggttgtgaaaggtcatcagccagggctattgtaatcaacagggaatggcgtgttgcgtcccataaggagtttacttgattacacatattagcccgcttggctcaatggatatgttgtcgcaactggaagtggacatgctgaaacgcacggccagtagcgacctgtatcaactgtttcgtaactgttcacttgccgttcttaactccggcagcctgaccgacaacagcaaagagctgctgtcctgctttgaaaatttcgatattaacgtactgcgccgcgagcgcggcgtgaagctggaattgattaatccgcctgaagacgcctttgttgacgggcggattattcgtgcgctacaggctaacctgttcgcagtgctgcgcgacattctctttgtgaatgggcagatccacaatgccggccgtttccagcatctggatcttgaaagctcaacacatatcaccaatctggtgttctccattttgcgcaacgcccgggcgctgcacgtcggcgaagcgccaaacatggtggtatgctggggcggccactcaattaacgaaaacgagtacctgtatgcccgtcgcgtcggcacgcagttgggattacgcgagctgaacatctgcaccggctgcggccctggggcgatggaagcccccatgaagggcgcggcggtcggtcacgcacagcagcgctataaagacagccgctttatcggcatgactgaaccttccattattgcggctgaaccgcctaacccgctggtgaacgaactgatcatcatgccggatatcgaaaaacgcctggaagcgttcgtccgtatcgcacacggtatcatcatcttcccgggcggcgtgggtacggcggaagagctgctttatttgctggggattctgatgaatccagccaataaaaatcaggtgctgccgctgatcctgaccggaccaaaagagagcgccgattacttccgcgtgctggatgagtttattacccatacgctgggcgaagcggcccgccgtcattaccgcatcatcattgacgatgcggcggaggtagcgcggctgatgaagaaagcgatgccgcaagtgaaagagaatcgccgcgatactggcgacgcctatagttttaactggtcgatgcgtattgcaccggatctgcaggtgccgtttgagccgtcgcatgagaatatggccaacctgaaactgtacccggatcagccggttgagattctggcggcggatctgcggcgcgccttctccggtattgtcgcggggaacgtgaaggaggtcgggatacgcgccattgaagctaatggtccgtataaaatccacggcgatcgagagatgatgcgtcgcatggacgatctgctgcagggattcgtcgcgcagcatcgtatgaaattgccgggttccgcctacatcccctgttacgagatctgcgcttaacgcttatgcccggttgccgccagcagccgggcgcttctcccattcctttcattgcggtatggcgattcacgtatgccttcattttttatgatgatcatcagaggtatagcccgcattgttttataaacaccatttataatttaccataaatagattgccaggcaaacgtttacctgactcctcttaccgtgatttatcggttcaaactctcattcttcgcaagaatccactaaaaaccttgatttttatagtcaaacctccgtatcttgcgccccaatctttccggccttatatcgttaatggtagccttcgcgcccggaaattcgttatgacgtttttttaatagattaatggtccaaatttatccatgtaagaagcggattattgcatttgagatcgggatcactgatagattcatcacttaaatgtatctttccgcccgaaaattattacggcgaaaaattatataaaaagcgtccctaagcagatttcattttacgatcaggtcttttttcattggattagaccagcaacctgatttttagcatcctccaggagaaatagatgaaaaccactcagaccagcacgattgcttcgattgactctcgaagcgcatggcgcaaaacggataccatgtggatgctgggcctttacggcacggcaatcggcgcgggcgttctgttcctgccgatcaacgcaggcgtcggcggcatgattccgctcatcatcatggcgattctcgctttcccgatgacctttttcgcacaccgtggtttaacccgcttcgtgctgtccggtaaaaacccgggtgaagacatcactgaagtcgttgaggaacacttcggtatcggcgcaggtaaactgattaccctgctctacttcttcgcgatttaccccatcctgctggtttacagcgtggcgattactaataccgtggaaagcttcctgacccaccagttagcgattaatccgccgccgcgggcgattctttccctgatcctgattgttggcatgatgaccatcgtgcgcttcggcgagcaaatgatcgttaaggcgatgagtatcctggtattcccgttcgtcgctgcgctgatgctgctggccttgtacctgatcccgcagtggaacggcgcggcgctggaaactctgtcctttgattccgccgcgtctaccggtaacggtctgtggatgacgctgtggctggcgattccggtgatggttttctctttcaaccactccccgatcatctcctccttcgcggttgcgaagcgtgaagagtacggtgaaggcgctgagaagaaatgttctaaaattctggccttcgcccacatcatgatggtgctgaccgtgatgttcttcgtcttcagctgcgtgctgagcctgacgccggcagatctggcagcggcaaaagagcagaacatctctattctgtcttacctggcgaaccactttaacgcgccgatcatcgcctggatggcgccgatcattgcgatgattgctatcaccaaatccttcctcggccactacctgggcgcgcgtgaaggctttaacgggatggtgattaaatcgctgcgtggtaaaggtaaatccatcgaaatcaacaaactgaataaaattaccgcgctgttcatgctggtcaccacctggattgtggcgacgctgaaccccagcatcctgggcatgattgaaaccctgggcggcccgatcatcgcgatgattctgttcctgatgccgatgtatgccatccagaaagtaccggcaatgcgtaagtacagcggtcatatcagcaacgtattcgttgtgattatgggcctgattgccatctccgctattttctactcactgttcagctaagtcctttagcgccgcttaccgcggcgcttctctatgatacaaccgcaatggatgccctatgattagcgtattcgatatttttaaaatcggcattggcccttccagttctcacaccgtcggaccaatgaaagcaggcaagcagttcacggacgatctgattgcccgccatattcttacagatgtcacccgcgtcgtggtggatgtctacggctctctgtcattgacgggtaaaggccaccacactgatatcgccattattatgggcctggcggggaatctgccggacaccgtcgatatcgacgccattccgtcctttatccaggatgtgaacacccatgggcgtttactactggccaatgggcagcatgaagtcgaatttccggtcgataagtgcatgaatttccacgccgacaacctgtctctgcatgagaacgggatgcgtattaccgcgctggcgggcaataaagtgctctacagccaaacctactactccattggcggcggctttatcgtcgatgaagagcactttggtttgacaaatagcgaacccgttaacgtaccgtatccttataaaaccgccgcggatttacagcgccattgccaggagacgggtctgtcgctctccggtctgatgatgcaaaacgaactggctctgcacagtaaagaagcgctggagcagcacttcgccaaggtctgggaggtgatgcgcagcggtattgagcgcggtatcaccaccgagggcgtattgccgggcaaactgcgcgttccgcgtcgcgcggcggcgctgcgtcggatgctggtcagtcaggataagaccaccaccgatccgatggcggtcgtcgactggatcaatatgttcgcgctggcggtgaacgaagagaatgccgcaggcggacgagtagtcactgccccgactaacggcgcatgtggtattgtgccggcggtgctggcgtactatgacaaatttatccgcgaagtaaatgctaactcacttgctcgctatatgctggtcgccagcgcgattggctcgctgtataagatgaacgcctctatttccggcgccgaagtgggttgtcagggagaggtcggcgtggcctgttccatggcggcagcgggtctggccgagctgctgggcggtagtccggcgcaggtgtgtatcgccgcagaaatcgccatggagcataatctggggctaacttgcgatccggttgccggtcaggtccaggttccctgcattgagcgtaacgcgattgcttcagtcaaagcggtcaacgccgcgcgtatggcgctgcgccgaaccagcgaaccgcgcgtatgcctcgataaagtgattgagaccatgtacgaaacgggtaaagatatgaacgctaagtaccgcgaaacttcgcgcggcggcctggcgatgaagatcgttacctgcgattaattctcagcacattttaggatctgtaggccggataaggcgctcgccgccatccggcttttgttgcctgatggcgcttcgcttatcaggtctacggatagcgcgatttcgcaatgctcgcctccccccgccgtgaatgttaccctacgcgcaggtttgtaagggagaacaccgtggctgctcatctgcttatcgtcgacgcgctcaatttgattcgccgtattcacgccgttcagggatcgccctgtgtggaaacctgccaacacgcgctcgatcaattgattatccacagccagccaacccatgccgtagcggtatttgatgacgacgcgcgcagcagcggctggcgtcatcagcgtttgccggactacaaagcaggacgtccgccgatgcctgacgatttacataatgaaatgcccgccctacgcgccgcgtttgaacagcgcggcgtacgctgttgggcatcagacggtaacgaagcggacgatctggcggcgacgctggcgctaaaagttaccgaagccggacaccaggcaaccattgtgtcaaccgataaaggctattgccagttgctctctccgggattgcgcattcgcgactacttccagaaacgctggctggacgcgccgtttattgaaaaagagtttggcgtactcccccggcagttgccggattactggggtctggcaggaatcagtagttcgaaagtccccggcgttgccggtatcggccctaaaagcgcgacccagctgttggttcagtttcaaaatctggagggaatttacgcccatctggacgaggtgccggaaaagtggcgcaaaaagcttgagacgcataaagaaatggcatttctttgccgcgatattgcacgtctgcaaaccgatttacatatcgacggaaacttacagcagctacggctggtacggtagttttgttgccggatggcggcgtgaacgccttatccggcctacagaactgcacgaaatgtagagcggataagcgcagcgccatccggcaaaattaccaggcggtatgatacagttcgacaatgtccgccagactcgcttcacgcggattgccgcccgtacagacatcatcgaacgccgcctgcgccagcgccgggatatcctcttttcgaacgccgacatcacgcaaatgcagcggaattcccacatcgcgatttagcgtaaatacggcttccactgcggcattacgcgcctcttcaaggctcaatccttctaccttcacccccatcgcccgggcgatatcacggaatttctcgttggtagacccggcattgaaacgcatcacatgcgggagcaaaatagcattcgcgacgccgtgcggcgtgttgtaaaacgcgcccaacggatgcgccatcccatgcaccagtcccagccccacattggaaaaccccatcccggcaacgtattgccccagcgccatcgcctcaccggcctctttttctccggctacggcgccgcgcagcgcgccagcaataatctcaatggctttgatatgtaatgcatccgtcagcgcccatgcggcccgggtaatatagccttcaatagcatgggttagcgcatccacgcccgttgccgctttcagcgcgggcggcataccgtccatcatatcggcatcgataaatgccgcctgcggaatatcatgcggatcgacacaaacgaatttgcgccgtttctcttcatcggtaatcacataattgatagtgacttccgccgcggttcccgccgttgtcgggatcgccataatcggcacgctgggtttacgggtcggcgatagcccttccagactgcgcacatcggcaaattccggattgttactgataataccgaccgctttgcaggtatcctgcggagaaccgccgccaatggcgatgagatagtccgcgccactttgggtaaagaccttaagcccttcctggacaacggaaatcgtaggattagggatcacgcccgcatagatctcccacgccagccctgcggcatccattctgcttgtaaccttatcgaccacaccgcattgcaccagcgttttatcggtaacaatcagcgccttatgataaccgcggcgcgtcacctcatcggttaatgcgtccaccgctccccggccaaaccatgccgtttcattcagaatcattctgttcgccatcgcctgtctcctgacatcactcttcaatacgtaatccgtaagttttaaatttctccagtacgatagcgatcgcctcgtcatccagtaccggtaccggatcgacaatggccagcgtacttaaatagagctgcgccagcacttccacttcatgcgccagccacaacgctttgtctaaattttcttcacaagcgataagcccgtgatgctgtaacagcgtcgctttacgatttttaagcgccacggcaacatggtcagaaagttcgcgggtgccaaaagtggcgtagggcgcgcagggaatagagttcccccccgcggcggcaatcatgtagtgaatcgccggaatcgggcgattcaggatcgagactgccgtacaatggacagcgtggttatgtaccacggcattggcgtcagggcgcgtctggtatgccgccatatgaaaacgccactcgctggaaggcagcttgccctgctcatgctgaccgtctgcatcaataaagacaatgtgcgactctgtcagcttctcgtaggggatccccgtcggcgtaatcagcattccgccctgataacgtacgctcacgttacctgccgtcccctgatttaaccctaaccgcgtcatttccagacaggtatcaataatctgccgagccagtctatttcgttccattatttacctctctctgtgattcaaaatgagacaacaaaaccgcctttcgcatcacgctgctgtcctgttgaaataatcgaatagttagcaactatcatcatactgaataaagagaagggaatttaaataacaatattttgtgatacacatcaattaattcgccacgataaaccagacgactgccatttctctcgccgataaatgcccgctcttaataatatttttcaaaacgggcaaagatgaaaaataagttaccactgaccgttttcgtagcaataatttaattcgggcattcagcctgtggttttttaaattaaacatttcaaacggtcatttttttatgaaaattaaagtgatgataatcacagaacgctatgctctcaggtataaatgtgaccgccatcatattaaaaggccttttttatttgaaaatgactccatgagttcattccggacgccaatttattaccggtaagaaaagcgaactcacctaattttacggtctggtgaccagaaccgaccgcacgcaaaagcttctgaaccgatgaggatgctatgggaaacacaacaatacaaacacagagttttcgtgctgtggatgcagagcaaagcaaaagcaagcgctacattattccattcgccttactttgctcgctattttttctgtgggccgtcgccaataatctgaatgacattttattaccgcagtttcaacaagcttttacgctaactaacttccaggccggacttattcagtcagccttttatttcggttatttcgtcattccaattcccgctgggattttgatgaaaaaactcagttataaagcagggattatcactggactttttttgtatgcttttggcgccgcattattctggcctgccgccgagataatgaattacacattatttttaattggcctgtttatcatcgccgccggtttaggctgccttgaaactgcggccaatccttttgtgacggcattaggtccagaaagcggcggacatttccggcttaatctggcgcaaacttttaactcctttggcgctattatcgccgttgtgtttgggcaaagccttattttgtctaacgtgccgcatcaatcacaagaagcgcttgataaaatgacgccggatcagcttagcgcctataaacacagcctggtgttatcggtacaaacgccatacatgattatcgtcgccatcgtattagtagttgcgctgctgattatgctgaccaaatttccggccctgcaaagtgacgatcatagcgatgctaaacaaagctctttcttatcttctctctcccgactcatccgtatccgccactggcgctgggcggtgctggcgcagttctgctacgtgggggcgcaaaccgcctgctggagctatctgatccgctacgccattgaggagatccctggaatgacgcccggtttcgccgccaactacctgaccggcacgatggtgtgcttctttatcggccgtttcaccgggacctggcttatcagccgcttcgcgccgcataaagtgctggccgcctatgccctgcttgccatgctcctgtgtctgatttccgcctttagcggcggacatatcggcctgctggcgctgacgttgtgtagcgcatttatgtcaatccagtacccaaccatcttctcgctgggtatcaaaaatctgggacaggacactaagtacggctcgtcttttatcgtcatgaccattattggcggcggtattgtcacgccagtaatgggcttcgttagcgacgccgcaggcaaaatcccgaccgccgaactggttccggcattgtgctttgccgtcatcttcatttttgcccgtttccgttcacaagcggcgacaaactgaacatttatccgaataacgtgaggaatctgtcatgaaaaaaatcagcttaccgaaaatcggtatccgcccggtgattgatggacgttgtatgggcgtacgcgagtcgctcgaagagcaaaccatgaacatggcgaaagcgacggcggcgctcatcaccgagaaaatccgccacgcctgtggggcacaggtggagtgcgtcattgcggatacctgtattgccggaatggcggaatccgccgcctgtgaagaaaaattcagtagccagaacgtgggcgtgaccattaccgttacgccgtgctggtgctatggcagcgaaaccattgatatggacccgatgcgtccgaaagccatctggggctttaacggcacagagcgtcccggggcggtttaccttgccgcggcgctggcggcgcacagccaaaaaggcattccggcgttctccatttatggccatgacgtgcaggatgccgacgatacctccattcctgccgacgtcgaagaaaaactgctgcgttttgcgcgggcagggttagcggtagccagcatgaaaggcaaaagctacctctccgtcggcggcgtgtcgatggggatcgcgggttccattgtcgatcataacttctttgaatcctggctgggcatgaaggtgcaagcggtagatatgaccgaactgcgccgccgtatcgatcaaaaaatttatgatgaggccgaactggagatggcgctggcgtgggcggataaaaacttccgctacggcgaagatcaaaacgcctcgcagtataagcgcaatgaagcccagaaccgcgcggtgctaaaagagagcctgctgatggcgatgtgtattcgcgacatgatgcagggcaacaagacgctggcggacaaagggttagttgaagaatcgctgggctacaacgccattgccgccggcttccagggccagcgccactggaccgatcaatacccgaacggcgataccgccgaagcgctgctcaatagctcttttgactggaacggcgtacgcgaaccgtttgtcgtcgccaccgaaaatgacagtctgaacggagtagcgatgctgtttggccatcaactcaccggtaccgcgcagatattcgccgacgtgcgaacttactggtcgccggaagccgtagaacgcgtcaccggccaggcgctcagcgccctggcggaacacggcattattcacctgattaactccggttctgccgcgctggacggtgcctgtaaacagcgcgacagcgaaggcaagccgaccatgaaaccgcactgggaaatcagccaacaagaggcggatgcgtgtctggcggccactgaatggtgcccggcaattcacgaatacttccgcggcggcggctactcatcccgttttctgaccgaaggcggcgtgccattcaccatgacccgcgtgaatatcatcaaaggcctgggaccagtactgcaaatcgccgaggggtggagcgtcgaactgccgaaagcgatgcacgatcagcttgatgcccgcaccaactctacctggcctaccacctggtttgcgccgcgtcttatcggcaaaggtccgtttaccgatgtctattcggtgatggcgaactggggcgctaaccacggcgtactcaccatcggtcatgtaggggcggactttattactctcgccgcgatgctgcgtatcccggtatgtatgcacaacgtggaggaggcgaagatctaccgtccttccgcctgggcggctcacggtatggatatcgaaggctaggattatcgcgcctgccagaattatggcccgctgtataaacgttaatgcggcttagcccggtggcgctggcttaccgggcctacgggcgcgtgaaccgtaggccggataagcgtagcgccatcaggcggcgtttatggagttatctatgaaacaagacgttatcctggttctcgactgcggtgcgactaacgttcgggcgatcgccgttgatcgccaggggaaaattgtcgcccgcgcctcaaccgctaacgccagcgacattgccgcagaaaatagcgcctggcatcagtggtcgctggacgccatcctgcaacgtttcgccgactgctgcaggtcactctccagcgccctgtcggagtgtgttgttcgcggtattacggtgactactttcggcgtcgatggcgcgctggtcgatgcgcagggtaagctgctctacccggtcatcagttggaaatgcccgcgaaccgctgccgtgatggaaacgattgagcgctttatctcgccccggcaattgcagacgctctccggcgtcggcgcgttcagctttaacacgctgtataaactggtctggcttaaagagaatcatccgcgcctgctggaacaagctcactgctggctgtttatctcgtcgctgattaaccaccgtctgaccggagagtttacgaccgatatcactatggcaggcaccagccagctactggatatccatcagcgcgactttagtccggaaatcctgcaggcgacgggcctggcgcgccgcctgttcccgcgtatcgtggaagcgggcgccccgataggcacgctacagacagacgcggccaggctactcggtctcccggcgggtgtgccagtgatctctgccgaacacgatactcagttcgcgttattcggcgctggcgcgcagcaaggtgaaccagtgctctcctccggaacatgggagattctgatggtgcgcagcggtcaggtggatacctcgctgctcagtcagtatccgggctcgacctgtgaactggacagtcagtcggggctttataaccccggaatgcagtggctggcctccggcgtactcgaatgggtacgaaaactgctgtggacgccggaaacgccatggcaaacgctgatcgacgaagcgcgcgctattcccgctggcgcggaaggcgtgcggatgcagtgcgatctgctcgcctgtcaaaatgcaggctggcagggcgtgacgctcaataccacccgcggccatttctatcgcgccgcgctggaaggcctgacggcgcaacttcagcgtaatctgcgcacgctggagaaaatcggccattttaacgccacagaactgttactggttggcggcggcagtcgcaacgctttgtggaatcaaattaaagcgaatcaacttgatatccctatcaaagtgctggacgacgcggaaaccaccgtggccggcgctgccatgtttggctggtacggcgtaggcgaatttagtagcccggagcaggcgcgtgcgcaggtcaattatcagtatcgctatttctggccgcaaaccgaacctgaaattattgagggagtatgaaatgctaaaaaccatttcaccgttaatttccccgacactgctcaaagtgctggccgagatgggccacggggacgaaatcattttttctgacgctcactttcccgcgcatagcctgggcccgcaggtgattcgcgccgatggtcttagcgtcagcgatctactgcgggcaatcattccgctctttgagctggatagctacgccccgccgctggtgatgatggccgccgtagaaggcgacacgctcgaccccagcgttgaagcgcgttatcgcgatgctttgtcattagaagcgccgtgcccggatatcgttcgtatcgaccgctatgcgttttatgagcgggcgcaaaaagcgtttgcgatcgttatcacaggtgagtgcgcgaagtacggaaatattcttttaaaaaaaggggtaacgccgtaatctcttgccggtgcgcccgcatgacgcgggcgttcatcgaatgatggggtgagaaaaatgaaagcggcacgccaacaagcgatagtcgatctgctgatcaatcataaaagtctgaccaccgaagcgctggccacccggcttaacgtcagtaaagagaccatccgccgcgatctcagtgaactacagacgcagggaaaagtgctgcgtaatcacggacgagctaaatatattcatcgtgaaaatcaggacagcggcgatccattccatatccgcctgaaaagccattatgcgcataaagccgatattgcccgtgaagcgttagcgtggatagaagaaggaatgacgattgcgctggatgccagttcaacctgctggtatctggcccgccagttgccggatattcccattcaggtttttaccaatagccatcctatctgtcaggagctgggaaaacgcgaacgcattgcgctgataagttccggcggccagcttgaacgtaaatatggctgttacgttaatccgtcgcttatctcacagctaaaatcgcttgatatcgatctgttcatcttttcctgcgaggggatcgacggcggcggcgatctgtgggactccaatgcgatcaacgccgattttaaatctatcctgctcaggcgcgcctcgcagtctttattattgattgataaaagtaaatttaatcgttcaggagaggcgcgcatcggccatctggatgatgtgacgcatatcgtttcagatgcgccgcagtcataggccggataagcgtgcgccatccggcgctgatgacgcgccggatgacggcagcgcgtttttatcgctcgtcgcgacgtccgccaacagccgcccacaaccgacgcacgtgtaccgtcacttcttcgcgatcgtgataaagctgacgcgcctggatctgcgcattaacgccatgctcatccaactgcgcctgaagatacgccaggttatgcgatacctcttcatagcgttttttcatcggcagtttaaggttaaaaatcgtctcccgacaccagccgttcaccagccactgcgccattaacgcggtgactttggccggcttctccaccatatcgcagaccatccatgaaatattattccggttcggacggtacctgaagccatcctcacgcaaccaggtcacctgtccggtgtccatcaggctttgcgccatcgggccgttatctacggagtagacccacatattgcgcttcactaactggtacgtccatccgccgggacaggcgcccaaatccaccgcgtacatgccgtttgccagacgttcatcccactcatcttccgggatgaaaacgtggagcgcctcttccagtttcagcgttgagcggctcggcgcatcagacggaaacttcaaacgcgggatgcccatataaaacggtgaattgttatgcgcgaacgaataaccggtatagcagcatcctggcgcgataaaaaagacatgaacgaccggacgcttcggcgtttcataattcgtcaatacgcccgcatcacgcaaagccgcgcgcagcggcaccgtaaatttgcggcagaacttcatcagttctttactttcattggtgtcggcgacttcaacccgcagctcgccgcccttttccactacgccctgcaacatgccgacaatcggcgtgattctgtcttccggcggtaaatgttgcagcagttcacccaccacaaaccactggcgggcgaaaatcagcgaactgaacggcagttctgaaatcagcttttcgccatcttccggctggtagcattcataaatgacatagcctgcgttctcttttacgcgtgcaaaaccaaatatttcccgttttcccgctttatcggtaatttctgcagcgcactctttttcaaaccccggacggcagagcaagacaactttattcatggctcgcgcccttacgtttcatacgaatggcgccaatcagcaatagcgcccagcccaccaggaaactgacgccgccgacaggcgtgatatacgcccacaggcgcagatgcgaaagcgcaaggcagtacaggctgccgctaaacagcaccgtgcccagcgccagaaaaacgctgctccagtaaaaccagatgctgatacggcgctgcatcgccaccgccaggccaaagatcgccagcgtatggaacgcctgatattgcaggccggtctgaatccagcccatttcaaccacgcccagggttttactcaaaacatgcgccccgaacgcgcccagagcaacgtaaataaaaccgctgatagcggcgacaatcagcataaaacggctggtcatggtcataccctaagttaattattgttcgtaacgaaaacggaatttttcttgctccgtcgccgccttcgccaaaatccactgacggaaggcggctattttacccagttctgcctggctgtcatgacaaaccagataaaaagcattcttactcaccagaacatcgttaaatggacacaccagtcgcccggcttcaatttccgactgcgccataacattattcgccagcgcgatcccctgtccgtgaatagccgcctgtagcaccatcgcgctgtggctaaatatcggcccttgctgaacgttaatatggttgagccctaactgacgagtataggcctgccagtcacgccgggaggcatcgtgcaataacgtatgtttcgccagatcctccggcgtttttaacggtttttcgcctgtgagcaataaaggagaacagacgggcaataaatattctgcgtataatttttcgacgcgcaagcccggccagtttccccggccataaaaaatcgcgacatcgacatcgtctgccagtttatcttcctgacgatcaacggcttgtatccgaacgtcaattcccggataagctgagttaaagctggagagcctgggcaccagccactggatggcaaaactgggcggtaaactcaccgtcagcgcccctttggcactgcgcgcctggagcttacgcgttgcttccgttagctgggaaaatatctctttaatatcaagaaaatagctttggccttcttccgtcagcagcagcgaacgattgcggcggcggaacagttttagccccaaaaaatcctcaagtgacttaatttggtggcttactgcggcctgcgtcacaaaaagttcttccgctgctcgcgtaaaactcaaatggcgcgcggcagcatcaaaaacgcgtaacgcatttaaaggaggtaatcgttttgacatggcctctggacttaatgtcgaatgaatttaacaaataggtaacaataggtaacctattagtttttttaatctgagacattataaattgtccgttgaggttctaccagcaaatacctatagtggcggcacttcctgagccggaacgaaaagttttatcggaatgcgtgttctgatgggcttttggcttacggttgtgatgttgtgttgttgtgtttgcaattggtctgcgattcagaccacggtagcgagactaccctttttcacttcctgtacatttaccctgtctgtccatagtgattaatgtagcaccgccatattgcggtgcttttttttgtataacaaacggttagttttccagagccaccatctctttcacgtcagtacgattgatctgctgtttgttgccattagcgtctttatacgaaatcataccggtatcgttatcggtctggggtttaccgtcggtcacaatgctacgtccatcattggtgtgcataacgtaattaggaccggaacaggcgctcagggcaaaagtcagcatacatgcagagataattgcggcagtctttttcatcttcttctccttaaagctgtttgtgctatttaaagcggactccgtaacaggcttaaacattcgcctaacattattcagcataacctcctttacataattcgccaggatatacagacgattccgatggttaggacaaaccttgtatcagccgcgcttttacgccacgatcggtaaactgaaccgaggaatatcatgaacgcttttaatcccacgcagtttcgcgcgcagtttcccgcgctagccgatgcgggtgtttatctcgatagcgccgccacggcattaaagccacaggcagtcattgacgccacgcaccagttttattgtttgagcgccggtaacgttcatcgtagccagtttgcgcaggcgcagcgcctgacggcgcaatatgaagcggccagagcaaaagcggcgcggctgttaaacgcgcccgatgaaaaaagtatcgtctggacacgcggcaccaccgaagcgatcaacatggtggcgcagtgttacgcccgtcctcgtctgcgccccggcgatgaaattatcgttagcgtcgccgagcatcacgccaaccttgttccctggctgatggtggcgcaacaaaccggcgcgcaggtcataaaactgccgcttaatgaccgacgtcttcctgatgttgagcgtctgccggaactgatcacgtcgcgcagccggatactggcgctggggcaaatgtcgaacgtaacgggcggctgtccggatctcacaggcgctatcagcgccgctcacgcggcgggaatggtcgtgatgatagatggcgcgcaaggcgctgtacacttcccggcggatgtccagcagcttgatatcgatttttatgctttttccgctcacaaactgtatggcccgaccggtatcggcgtgctgtacggtaagccggagcttcttgaggcgatgtcgccctggctcggcggcggcaagatgatccgtgacgttagctttgaaggcttcaccactcaaagcgctccctggaaactggaagcggggacgccgaacgtcgccggggtcatcggcctgagcgctgcgctggaatggctgtccgatatcgatattgaacaggccgaaaactggagccgggggctggcgacgctggcggaagacgcactggcgaaacgtccgggctttcgttcgttccgctgccaggactccagcctgctggcctttgattttgtcggcgtgcaccacggcgatatggtgacgctgctggcggaatacggtattgcgctccgggccgggcaacattgcgcccagccattgctagcggaacttggcgtcacagggactctgcgcgcctcttttgcgccgtataatacccaacatgatgtggatgcgttggttaacgccgttgaccgcgcgctggaactgctggtggattaatgacaaaccctctttataccggacacccgttcggcacaacggtaacggaagagacgttacgcgctatctttctcccgctgacccaatgggaggataaatatcgtcagttgattctgttaggaaaacagctccccgctctgccggatgaatgcaaagcgcaggcgaaggagatagccggctgcgagaaccgcgtctggctgggctttacccgatcagataacggaacgatgcactttttcggcgacagtgaggggcggattgtccgcggcctgctagcggtattgctcaccgcggtggaaggaaaaaacgccgccgagttgcaggctcgttcaccgctggcgctgtttgatgagctgggtttacgcgcccagcttagcgcctcacgcagtcaggggctgaacgcgctgagcgaagcgattgttgccgcaacgcataagggttgaaatagcgtaaatattctgtcgcctgacagcgccgtccgcggcggtcaggcgatgcagataaaataatccagtcactttattagtttcggcatcagatttccctgataaacattcttttgatttttatcagctatcacaatgaaattacaatgttagaatccatgttaaaatggcgtgaagattttagagtaaataaaaccactcgatgtagcgtagcaggagaactggaaaattcatacgcatcgggtgaagttataacaggatatggataagtggaaaaatatctgcgtagcggtaccatgtttgtggtgctggcatttatattatgggggttaacacctttatattatcaatatttatcagggggaaatctcgcacaaatattgatataccgggtgttctggtcaattccattattactggcagtaaggttgttatttcggcagcgaacgcgatttcatgatgcctggaaagataaaaaatcctttttcttctgcatgatcgccggacttttgatgattgtctcatggtcatctttcatttatgcgctaacccatcatctggtacttgatgccagcctcggctattttatcaacccgctatttgttattgcgctgggatgcatttttcttaaagaaaaactgtcgttgtttcaggccatcgccgttttttctggtgtctgtggcctgacttttcaaattatcatgctacggcatttcccggcgctggcgctaaccatgggattatcatttgcgctatatggcctggcgcgaaagtttatacattatgatgtgatgacatcgataacgattgaaacattatgggcattgcctgtctcactattaatttttctctttagcgatactggaccaattatatccgctaatactcctttctttttgtatgtcatgacggcgccagtgacgatcattccactggtattatttgccatcgcgttaaatcacacctcgttgattgtcaccggactggcgcaatatatagagccgtctttacagttcttacttgccattatgatatttggcgagcacattaattacgcggaactgctctgcttttgtgcagtatggttcgggctgtttctatgcatatctgaaaatttatattcccattatctccgcgcccgtctgaaaccggtgttcggcagggtacagcgcttctttcgctaacaaagggcgcagggccggatacgcgtctgcgtgacactccgccccgtccttttattcttgtcgcgccgctttagccatgatcttcttcagcgcatgggaaacggcgacaaaaccgaacgttgccgttaccatcgtcgccgcgccgaagccagaggcgcaatccatccgttttggcccttctgcggtagctttcatcgcgcatacggaaccgtccgcctgtgggtaaaccagcgcttcggtggaaaaaacgcagtccacgcccagcttacctttactgttcttcactacgccaaaattatgtttcaatctctcacgcagttttgccgccagcggatcctggatagttttcgccaaatcagcgacctggatttgcgtcggatcgatctgcccgcccgcgccgccagtggttactaaaggaaccttatatcggcgacagtacgcaatcagcgcggcttttggacgaacgctgtcaatggcgtcaatgacataggtaaaacccgcgtccatataacccgccacattatccggcgtgatgaaatcatcgataaccgttacccggcactccgggttaatttgccgaatccgttcggccatcacttccgctttcgccaacccaacgttatcacgcaacgcatggatctgacggttcgtattggtcacgcagacatcgtccatatcaatcagcgtaatcgcgccgatgcccgtacgcgccagcgcctctgccgcccatgatcctaccccgccgattcccacgacgcagatatgcgcctcagcaaaccgctgcagcgctttttcaccgtacagacgcgcggtgccgccaaagcgttggcgccaggcatcacttatcaccactgacatatgacctcagaataaaaaaggtgaggttattcctcacccctgctcactattttcaggcccgatagcaatcgcgttatcgggcaatccggttgtcgcagaataccacaatcagccgctaaacacgttaccggcgcccggcgcgctttttaacacccagacgcgaccatagtgattataccatccggcacgatgcccggcatccgggccaatcccctggtaaatatcaaagtgctggcctttaatcgctccgccgacatccagtgcgaccatcaaacgtagctcatactgaccgctaaatttaccgttgttatccagcaacggtacttccgccaacaaggttgtgcccggcggaatgatgctgcggtcggaggcgacggatgctcgcccaatcagcggtacagcgctggcgcctttgaccggcgcaaaagattgcggtttaaagaagacgaacgacgggttctgctccagtaattcacgcacttccgcttcgctgtgcttctctccccattcgcgtatagcctgcatcgacatatcttcttttttcacttcaccgcgatcgataagcactttaccaatactgcgataaggccagccatttttaccggcataactaaagaagttcagcggactaccatcaccgaaatcaatataaccgctgccctggacatccataataaagttatccatcagcgaattactccaggccaggatgtacttatcgctcagcgcgcctgcgtagatctgggcgcgggacggtaagcgtccgcgttttggcggcatactatagatagggtactggaacgcgccctggcgcgtatggcgagcctgaacgacgggcgtatagtagcccgtgaactggacgttaccgtagttgtcggtgccttccatctgccaggcatcgataccaaactgacgcatagtgcgcgtatcgcctccggaacgtaaccagttctggacagcgttatagacgttgctttgattggtgtataaacgcggcgacgcggaacggatctggtcgacctgctcggcaaagtcaccagcattaatcggcgcgcccaccgcgtccggctggtttaccagggagaagggctgggtaaatttcccgtccttatattgctgaccgcgatcggtcggttttgatgaacaggcagccagcattgccagcattacgcctgtcgccacatattttgcccaacgtcctttcatggtgtctcgtcttctgcgtaatcgaaagtgcccggtgaagataacaaaccgtccgaagtaatgaaatgcgatcgcgatctcattatgtaaattcgtttaaaaatcgcgctatctgcggtgtatttgcgcaattcatgagaaattagcgatttatatgaaaaaagggttgcaacaaaagctcagcggagtatagtgcgcatccacggacgcggggtggagcagcctggtagctcgtcgggctcataacccgaaggtcgtcggttcaaatccggcccccgcaaccaattacaatgagaatgcaagtttagacggacgcggggtggagcagcctggtagctcgtcgggctcataacccgaaggtcgtcggttcaaatccggcccccgcaaccaacttaatgaacacccttacgggtgtttttttgtatctgtcatctggtccgcaacgacagtgcgggcagcatcctacttacccgcgcaataaactcgccgtcatctcaggttaacttcttctcgccagcgtcgccccatcggcaaaataggctttaatgcccgccagaatcgactctgcgacctgttgctggaacgtcgcggtcttgagcttgcgttcttcttcaatgttactgataaacgccgtctcgaccagaatagacggaatatcgggcgcctttaacaccgcaaaccccgcctgctcgaccttgtttttatgcaggtcattaattttaccaagctgcttcaacaccgctttaccgaatttcaaactatcggcaatggtcagcgattgcaccatatcgaacatcgtatggtcgacataacggtcaccgcttttgctcacgccgccaattaagtccgaggcgttctgcgtttgcgccagatatttcgccgcagtactggtggcgcctttagtcgatagcgcgaatacggatgaaccgctaggctgccggctggtgaaggcatccgcatgaatagagacaaacaggtcggcgcgctgtttctgcgctttcgccacccggacttttaacggaatgaagatgtcttcattgcgcgtcatatagaccttcatgttgccttctttttcgatcaacgcgcgcaggcggcgggctatctggagcaccacgtctttttcacgcgttttgtatttgcctatcgcgccagggtcttcgccgccgtgtcccggatcaagcataatgacaatgggacgatcgcgccccgctttaccgggctgcggcccgctttgcgaaggcggcacctgtttatccagatcgcctttattgtagtcttccagcagcgccagcagcggatcctgcatatcctgcgcattagcaggataaagatctatcaccagacgttctttaaagcctgccacaggcgccagcgcaaatagctgcggcttcacgttttgttttagctcaaagaccatacgcacagtcttaggatcaaactgccctacccttgcggatttgatatacggatcgtcgctgcgaatctgcgcgccaatgcctttaagcaccgagttcagattcacatcctcaatatctaccaccacgcggtccgggttacttaaggcaaattgtttatatttcagcagacgattcgactctaccgtgacgcgggtatagctggacgcaggccagatacgcaccgcaacgacctggcttacggcagccagcccgacctggctcacgcttaatagccacatggcgcccgcgccttgtagtaaacggcgacggctgattgctgaattggctcccgacatgcttctcccgagcaaaaactaaatagagatcatacaaagttcatccaaattgaccggaaactttagcgaatgacgcataatctgtcatctataaaagggtaaacattctttttatattcacggcattactaagaaaagcgatcggaccgcataaaatttacgcttgcacagagggcaaaaacagaataaaaatacactaatttcgaataataattcactagtggggcgcgcaatgataaaggaacgtaaaaccgaactggtagaagggtttcgccattcagttccctatatcaatacccatcgcggaaaaacctttgtcattatgctcggcggcgaagccattgagcatgacaatttttccagcatcgttagcgatatcgggctactgcatagcctcggtattcgccttgtcgtggtgtatggcgcgcgaccgcaaatcgacgccaatctggccgcgcatcatcatgaaccgatttaccacaaaaacacacgggtgacggacgccaaaacactggagctggtgaaacaggccgccggtttactccagcttgatattaccgcccgtctgtcgatgagtctgaacaatacgccgttgcagggcgcgcacattaatgtcgtcagcggcaatttcaccattgcgcagccgctgggcgttgatgatggcgtggactactgtcatagcggccgtatccggcgcattgatgaagatgcgatcaaccgccagttggataacggcgcgatcgttctgatggggccggtcgccgtctcagtgaccggcgaaagttttaatctgacctcagaagagattgccactcaactcgccgttaaactgaaagcggaaaaaatgatcggtttctgttcttctcagggcgttaccaatagcgagggcggcatcatttctgaactcttcccgaatgaagcgcaggcgcgggtggaagagttggaagcgcagggcgattacaactccggaaccgtacgttttttgcgcggcgcggtaaaagcctgtcgtagcggcgttcgtcgttgccatctgatcagctatcaggaagatggctcgctattacaggaattgttctcgcgtgatggtatcggtacgcagatcgtcatggagagcgccgagcagatccgccgcgctaccatcaacgatattggcggtattctggagcttatccgcccactggaacagcagggcattctggtacgccgttcccgtgaacaactggagatggagatcgataaatttaccattattcagcgcgataatatgactatcgcttgcgcggcgctgtatccttttgtggaagagaaaataggcgaaatggcctgcgtagcggtacatccggattatcgcagctcatcgcgtggagaagtgcttctggagcgggttgccgcccaggcacggcaaatggggctgcgtaaattgtttgtgttgacgacgcgcagtattcactggttccaggagcgcggttttacgcctgtcgatattgagttactgcctgagagcaagaaaaaaatgtataactatcagcgacgttcaaaggtgctgatggcagatttaggataacaaggggggcctgatggcgctgcgcttatcaggcctacgctcgaaagcatcatttggaggccggataagatgctacgcgtcgccatccggcgagaactcgtcttatccgatacgactgacttcatcaaataaggtggctaacccgctgcgccgttccgttcgcgtcacaatcgcgcctgccaggatccgttcatcggcatacagcgataaccgccgccgcgcccgcgtaacagcggtatacaccagctcccgcgtcacgaccggcgaacgttggctgggtaaaatcagcgcggcgtgatcaaattcagacccctgtgatttatgtaccgtcatcgcccaggttgtatcatgttccggcagacggctgggctgaacggacttgatcgtgccgtccggcatcacaaaccagacgcgtaacccctgcccgcgatcgagcgcaataccaatatcgccgttaaatagccccaacgcgctatcgttgcgcgcaatcattaccggacgcccttcataccagcgagagtgcggatgccgctgaatttttcgttgctgcaccatcgcctgctcaatgcggtcattcagtcccctcacgccaaatgggccttcgcgcagcgcacaaagcagttgatactcattgaaagcctgaaggattgcctccggcgccgctttttcatgcagcaaccgcaggtagcgcccatagcccgccagcgcttcatccagcatcccggcataatcgtcgctgctttgcaatgtacgcttctctatatcgctaaacccctgctgaaaaacagcctggattgccgacctgtcgccacagttaattgccgccgccagcttgccgatgccagaatcgctgccgaaacggtagctcttttgcaacaaacagaggctatcgcgtaaagacgcggcttgcgttccggcccccgccggaatggcgctaccagtgagtcgacttagctgtcgggcgcgttccgccgtaaaccctgcgttgacataggcgcaaatatcgcccaacacagcgcccgcctcaacggatgccaactgatcgcgatcgccaagaaaaatgacccgcccgtgcggcggcagagcgtcaatcaaacgtgacatcatcggcaaatcaatcattgatgcctcatcgaccaccagcacgtccagatgcagcgggttgcccgcatgatggcgtaatcgctggctgccgggctgtgcgcccagcagtcggtgcagcgtactggcgtcctccggtatacgctttttctgcgcatcggtaagaggaagctgacgcaacgccgcgccgagcgactccgtcaggcgtgcggccgctttcccggttggcgccgccagccggatacggcaacgttcgccatccgccatttgaattaatgccgccagcagcttcgcgacggtggtggttttaccggtgccgggaccgcctgaaatcacggagatacggcgagttagcgctacggcggcggccaccttttgccagttcacctcgtctgtcggagggaatagcgcgtccagaatacgggataactgatcttcatctacggcgatggcctggttaacctcgttaaaaaagcgcgcaaccgtacgctcgttgcaccacatgcgattcaggtagaggcgatcgccgcacagaattaacggcgcggggctatcgccgcagctaaccgccgcagacgccagtaaccgctttttccagtcgattggcgtagccgtttcgcttatccaggcgaccagtaagggatgcgcctcctccgttaacgttaaacgcgacaacggcagacacacgtgaccttcacctgcgtcatgactaagcagcgctgccgccagcgtcacggcgggatcgtcgttaccggcgacggttaaagcaaactgggcatcaatgggccgtaagagtttttgttcaacggcctccagcaaccgcttctggattgtcattgcgcctcctcactcatttcacctgcaaacatatcatccagttggttaattaacgccgccgcaggacgagtggtaaaaataccctgctgcggacgttcgctatccaccccgcgtaaaaagagatagatgacgccgccgaaatggcgttcatagtcgtaattcgccattcgatgacgaaggtaacgatgcaatgccagcgtataaagctggtactgcaaatcatagcgatgcgcctgcatcgccgcagccatcgccgtctgggtataagcggcgctatcctcgcccagccagttagatttatagtcgagcaggtaatagcgcccctcataacggaacaccaggtcgataaagccctttaacatgccgcgaacctgcatgaaatccagcgcagggcaacctgctgaaagcgggtcgtatcgacgaatcaacgcatctaactctccggcggtaagcggctgggcaatcggcagataaaactccatttcaacctgtttttcacgctcggtcagcacgctcagactaacgcccgtctcgttaaggggaacgtgcaacacggtgtccagccagcgggtaagtacgggctcccatcgcgtttcaaaaccactcagctccagtttttcctgtacccattgggggtctatcggttgagtaaaatcaagctcttcaaacaggctgtgcaaaaatgttcccggcgatgccccgcgaggaaagtgatgcggcgtcattgccggcgcttccgccgcttcgccaacgcctgcggcgtcaatgtcgagacgaggaataagatcttgcgccacgctatgtccccgctgctgcaaaccggaataactggtgacgcgccagctatcataaagcaggcgttgcagcgttctggcgctgagttccgcgtgcgatgcagcggcaatttgccagcggtcgttatccgtattgcctggcgttcgacacacgatatcctcgtcgcatagcgcctcaatacaggcgcgaaggcctgcggcatccatcggttcgcctttttgcaggagtcgcccaagcgcgctttggtgcacatccgtctcgcctttcttatcgctacgacgccgcaccagcggcgcgacgccgaggctgcaatgccacactgcacgggtcagcgcgacataaagtaggcgcaggtcttccgccaggcgttcggcttccgccagtgctatgctctcttcggcgtgactaaggtccagcaccgcctcgtaggagtgcctgtcgtgataaaaagcctggtcctgcacgcggaaatgggtgataaaaggtaaccagaccagcgggtattccagacctttcgatttatgaatggtgacgatttgcaccagatgcttatcgctttccagacgtagttgctggctggaagcattgctatcaggttcaaggatatgttgcgccagccaacgcaccagcgcatgttcgctttccagctgcgaaccggcttcctgtaacagttcgctaatatgcagaatatccgtcagccgacgttcacctcccgccgtcgccagcaggttttcagcaatattgcgcgccgacattagcgcgcgcagcataggcatcacgccgcgtttatgccaaatctgtcggtagccatcaaactcttcaacaaccgcatcccacgcattttcatcattgttaagcgtttcgatatccagcgcggtaaggcccatcattgatgtcgccagagcgctacgcagcgtattctcacgttcgggcgccatcaccgcctgcaacacccacagcatttcctgcgcttcgagcgtttcgaatacgctgtcgcggttagaaagatagacggaggggatcgccagtaaggtcagcgcatcccgtatcagcgcggcttcccgcctgctgcgcaccagcacgctaatatccgaggcgcgaacgggccgcgacgaatcgccgttcgtcagcagcgcgtcgcccgtttgcccggcacgcagccagtcgcgaatttgcgtggcgcacacctgcgccatataactttgataatcgcccgaaccgcagctttccccctccattagccacagggtcatcgccggttgaggcgcgtcattcactttaaattgcagcgactggtttctgggcgcaaactttaccggactgaagggaatatcgcggaacataaaggcgtcattcatctgactgaacagcttgttaacgctattcaccatccccggcgcggagcgccagttagtgtcaagggtatagtgcgcgctcacttcgctgcgagccttcatgtaggtaaagatatccgcgccacgaaacgcataaatcgcctgtttaggatcgccaatcagcaatagcgccgtatcgggttgatgtcgccagatacggcgaaaaatacggtactgttgtgggtcggtatcctgaaattcatcgatcatcgccaccggaaaacgggtacgaatcgccgcagccagcgcctcgccgctttcactacgcagcgcggtatctaaacggctgagcatatcgtcaaaccccagctcgccgcgccgtcgtttttcctgagccaccgtttcacggatctctgagagcgctcgggtaagaaccagatctttaatcgatagcggttcgcccaacaggttatcaatggcgacaaacaatgggtgctggggcgtcacgcccccagctttggtgcgctcagctaaaaaacgctgtgaaaattttcccaacgcctcgggtaattgataatttttggtctcttcttgcgcccacgcggtgatcttttcgatccatttcgcctgattgccgcggttgaattttctgcgatcgatgccggatgattcgatcagcgcgtccagctcgctaaccgcctcacaccactgctgcttcacctggttgatgcgcgccaggatctgttcatggcgcgatgccagcgtctcctcctgcgatggcggcgctttaatgaccggcgcttcgccctgcagataacgatcgatatcttttaagagcgccttcggccccttccacacgtcaaacaccacctgcgcgatgtcgcgcggcagcggatagcaatgacgccgccagaaatcggcgcaggcctgataacgcaacaaagattcgtcttcaataagctgttgctcaaacaacataccggattcgaaagcgttcaggctgagcatacgctggcaaaaaccgtggatggtaaaaaccgcggcctcgtccatttgtcgttctgccagtaataaccactgcgcggcctgctttttgtcgctaatttcttccagcaagcgggcatacagcggattatccgtgctttcccgcagacaggcgatgcgcaactcatggatattactgcggattcgcccacgcagctcttcagtggcggcctccgtaaaggttaccaccagcagttcttcaacggtcaacggacggggaaatgcggcgctgccgcctaaaccgagcagtagccgcagatacagcgccgcgatagtaaacgttttgcctgtgcccgctgatgcttcaatcaaacgctcgcctgtaaggggcaagcgcagaggatcaagagtctcggcgacatcattcattcttttcgctcattagaggtaacgtttgctgcaaagcgctgacgttatcccacactttccagcctgtcggatgcacgtattctgcttttccattctggctaccggcaatctgtgacaatattgccataccttgtggttccaccaccgcctggtggaagaaatcggcaagcttttgtggcgtcagcaattttatctgagcgatgattttatcacgcgagtcaaagcgcatattaccccgatcgaaatccttgcttaaacgggatgcttcttcgcccaacgtttgcggcgcctggcgcatttgcgtaatgatcgcctgctgaatttgggcgaactcttccggcttcatcgccctcagcttcgcctcggcgtcagggaaaaatgcctgatagcgttgccacaggtaagagggctgtttatcgttgctctgtagcaggaatcccattccccactgacggccaacgctcatcggaaaggcgaaaacagcgtatcccagttgctcttcggttcgtagctgattgtaaaaccacggttgaacaatctgacctaacatcgcgctgtaggcggcgctgacgtactcgtcgtagccgaccgggacaaagaccgcggctaacgcggagtcggtgctactgcccgctttttcaaatattacggactgctttttctcaaccaccacgtctttgttacgacaccacgccgatccgttcgccgcgagctgtttttggacatcttgcgccagagaggtcgcctgggcttcgctcatatttcctataaccagaaattccggacgagcgcccgtttttaacgcattacgataggccatcacctcttttaacgtaatggacggcagcaaagcgcgacgttcatcacgggaaaaataaggcacctgcgaaatcatctgcaccggcataatcgcctgttcgtaggcttttcccttctccgcagaatccatcatctgcgtataccaggatttcgcctgcgccagctgttcttccgtggcgtcgtagctaaaatatccttccagcagcgccaggaaaagctgcggcaaacgctgggtataaccgttcgcagtgaccatcagaccattgttggcgttagtggaaaagctaatgccgcccactgccgcctggttgctgagctgatctagcgccattcccgccagataatcattaagggcgaacagtacctgattgcgggcgctgtccatcgcctgcgggttacgcaataccacactcacgtcagcttttggctcgctggcgaaataacgactcggcgcataaaccacgcgcaaatccgctttatcgacaatcagttctggccgcacgtagtttttgtcattcttaataagcgtaaaatcatcaggaatataggggtttaactccggcagcgacaacgcaatgccctgtgctttttgctgccagtttttaaacgtctgttcgctaatcttatcgacctgataaggcgcatccacaaaatacgcaatcttattatggggttcctggggactgatgtaccagatgcgcgcattctgcggcgtcatcatcgccaggcgatttttgatagcggcaggatcgtaacgatcggcgatattcgccgcatccagcgtatgcgctaccgggacgcggatcatagtgtccgccagccactcgacatagtccatatcgcgggtaatcgacggatagcggaagtcgagatccagcacatgcgccagctcgtcaaagtaacgtttatctatccctttttcacgtaacgtattgagatagctaaagatagctgcgacgacttcatcacgattggccaaacctttatcagtcagcgttgccgaaatggcaaatacgccgctgttaccattaacaatcggatcagaatccgcgctaataccttcgaccagtccttgtttttgcagccagtcagagagcgtccccgggctacgattgccaatcagataagagaccagttcatcggtcttgctacggaactgcgcgctattgttatcaatacgaaactccacgcgcagcactttacgcggtagcgccggcacgtaatgaataatgatgcccttctgcgcctcggtgatgacaggtacggtaatttccggttttttaatctgtttattcggcacgcgaccataggttgcggcggcaatactcgccagttccggcaagggtttattactgtaaatcaccgccttcatcagattagatgaatagtatttttcatgaaaagcgatcaacgcctgttgcaccggattgcccggcttatcgcttagcgtttccagattgccgcctgaaaagtgcgagcctggatgcgccgggttaatggtttcggcgcttacctgcgccatacgcataccgtcacgggtgcgcgccatcgtcagctcggcattcactgcgtttcgttcgcgttcggcatactttttattgagcaatggcgcggcaatggcgtcggccaagcgatctacggcacctggaagcgcgtcgttttcaacctccaggtagaaggctgttcgataaggtgcggtgctggcgttgtggctaccgccatgtcttttaaggtattcggcaaggctatccgcctgcggatatttttttgaccccatcaggcacatatgctcaagataatgagcaagcccctgatgagcctcaggatcttcaagcgatacaacgggcaccactaacgcagaaagagactttacagcctgcggatcggataccagcaacaccaccatgtcattatcaagacgtatcgcctgatactgccgggtatctttatcgcttttacggatagtttcttgcagcggttgccaaccgatatccgcctgaactgcaggcccccagagggcgaccaataacaataacgctttgaaccaggtgctgcggggcattcacggacctcatcattaactttcattcccactcatctgtatggtcacgtaaaccatcgacctgagcggaacgggatattattgtgctgaaccaggcagcatttttttatcagtaatcagtccgtgacgaagagcgcatcatagtcgaagccttttaatggcgcgattttcatacaatcaacgagactgattaaaacgaaacagcggtaacaggtaatgccgtgactgcgcaatgatagcctgcaacgtttccgattccagctgacgccaaagacgttgataccagatatcttcgccttcgccgctcaccatcatgttgccttcataagcctgtagaaactttgtcctggccttctgtaaagtatcatcgtcgtctaacatgacatcattttcagcgtcataacaggcttttatccatgcgccgccgctttccggcagtaccaatagcggagaagacatgccttcccggtagccttcaatcagttgcgccaggtaagccattgcctgcgttttatcaagaggcggaaatcgccattctccctctttgcgcaaaaacaggcgactttcgccactaccgccgctggcacaatagacaaggtgttccagccaaagttgcacaccttgcgccacgctgattaaagcgggacgccagcgcaataatccatcctcctgtacctgcggtagccagccggttagctgaactccattgcaaagcagatccacttccaggctttggctcggcttacggcaagcgataacccggcttgccagttgctgcatctcctgacactgcgcatcccagaatatttcgccaaacgcgccgtaaggcagctctcccgcagcccgaaaacggcggaacaagcgttcggcatcgtcctcttcaaccaacgtattgagcaactgttggttaagttgatatcgcgtcaatccctctaattcaaacggttcagcatcaggaatctcactctcttccgagcggaaattaacctgaagccgcatctgaaaaaatgcgcgtaccggatgggcccaaaaacgctgcagactttccagagtcaatgtttccggcatcgtaaaaggaagcggctgcacaaagtcagaatgcgcttttcccgactgactcgccgcgggcaaccactctctggcataactttgctgttcgccgggttggtaattttgcgcatcaaaaggcatacgggtatgcagacgcgtaatatgcgctttgactcgtgcttcgctctcatcacaggtcagcgtttcgtcgcccggcaaatagtggctttgcccgatgtaatccaccaattcttgcaccagtacagagggaaagcgttcgctattatcctggatggagcgaccgatgtagctgatatacagcgtctgctgcgccgagattaacgcttccagaaacaggtagcggtcatcgtcgcgacggctacgatccccgcgcatgggtttttggctcatcaggtcaaagcccaacggcgcaagctggcgcgggtatacgccgtcgttcattcccagcaggcaaacgactctgaacggaatggaacgcatcggcatcagcgtacaaatattgatggggcccgccaggaagcgctggctaatacgttcctgatccagacgctgcgccagctcatcccgcagtagcgaaatcggtaccgcgtcgccatattccgccgcgacgccttcggcgataatggcctgccactgctgttcaatcaatgtcattgccgcttccgtgtccgcatcgggcaggaagaaatcattgagcatgtcgcgacaaacgggcaaccactcttccagaggtcgctcctgcgccagaccgcgccgccagatattaagctgcatcagcagcgaagccagatgcccgaccagctcagcaatcagaccgctggattcgtcataaggcagaaccgactgccactcgccctgggcgctttccatcgcataccccagcagcatacgcgtcaggccaaattgccatgtatgctgccccgtggcaggaagttccagctcgcgcacgttgtcatcgtcaatcccccagcgaatgcctgactcattgacccacaagcgcaaataacgcagcccttcttcgttgatcgtaaagcgggcagccaataccggtacgtctaacaacgccagaacatcctcggagacgaagcggctgtccggtaacgaaagcagactgataaatgcctgtaacaccggatgtgactgacgcgcccgccgatcggaaatagcataaggcagatagcgctccgttggcgcgctaccaaataccgcctggataaacgggctatagctgtcaatatcagccaccataacgataatgtcgcgcggcgttagcgtcggatcggcttccagcatcgccagcaggcgatcgtgcagtatttccacctcgcgctgcgggctgtgacaaacgtgaaaagagaggctgttatcctcgggatcgagcagacgcttattgtcgctgcgcgaatactcctcaagatttacgcccgccaccgcatggctttccagttcaaggatatccgcctgaatccgatgcaaaagattatctggcgtaatatcaacaaacgcatccagctcctggctgttttccagttcagatagcaggtagatataatcccgtcccagttttccccatgaggccagtagcggattaccgatatcctgttcaccgtcgctgttaaataaggcttccggattctgattttcacggaacaacggtaaatgacggtcttcaaaactgtgacgacgctggcgagccatgagttttgccagccaggctgggtcttttatatccccccagtaataccgacacggattagtaaaaaggagatggatttcaatatgtttacccagcgcctgcaatgctttgagatacactggcggtaacgcggaaatgccgcaaataaaaacgcgggacggcaaccctggcgggcaggcggtcgcgctttccagcgtttgaataaagcgttggtagagattggcgcgatgccagcgcggctgccccagcgcggcggtatattccaccaatgctttccacagcggcgcctgccagttttgcgcctctcccagaccttccacggtttttcccgcctcccactgcgtaagccagtcaggccgataaaccagatactgatcgaacaggtcggcggcgcgcgcggaaagctgaaagagtttgcgtttatcggtgtcgtcggtcagataatggcgcagcagtacaaactcatccttatccagcaactgcggcagcaaggtcatcagtttccagctcatgctttgtttgctgaaagcgctttctttggggatatctggcaacacgcggacaaacatctcccagataaaactcgccggtaacggaaaagcgatattcgccgcaataccaaacttttgtgaaagggtcatctgcagccactgcgccatacccgtgctttgtaccagaatcatttctggttcaaagggatcatccagccgctcgcgttcgacgatgaactccatcaacgcttccagcacatccagacgattggagtggtagacccttaacataattactcctgacgattaacgatttggacaatgcaagcgcgtcatctgcccctgcctgccagagggtgaaaccatcgtgacgctgatgctgacacatcccgattgcgttgtctgcatccggttggcattccagccgtcagcaggcgaaaatggatacagcgccgtttgctgccacgcctgccgccagatctggagatactggtgtcgtaatgcaaaagtgtgcattaatacccgctgatagcctgacagcgcggtgacgatcattaccattagaaccatcgccactaaaacttccgggaggctaaacccgcgttgaaaattcaggggatgcgacataacgccacctcttttaacggacaaaaatcactccagccgtggggagaaaagacaatgcttccctgaatgacgttgcccaaacgccataacgtcatgccatcatcttgcgccgccatcaccacttcatcccccgataatctccgcaaacagaccctcgctcctgaagaggaatagcgccgacattccatttcggttacgcctgaccatagctgccctcgcccccattccagcgccgactgtacgagcgcctggcgttgtatcgccatgctctgcgtcgtcacgcgggcggcatagctggcctgctgctgatttacgccttgcagtagcagactgcccagaatcagtattaaaagcgccagtattagcgaagaagcgccacgttcccgattcacagattaaatcccgttacgctatattgcgcgtcaataaccgtctgaggctcggctttgctggcgccacgcagatgcagcatgagcactggcgagaatcccgttatatcccggcgctcaacgttaaacgccgtgatgagtaccgtattgggatcggtcattttttcccatcccttaccctggcaagatgttgctccgcgtaatgtctccagaacgttatccttcatacggaacccggtctggtcggcctctttcgccggtatggtatcccagaccccgttattattcccgtcccactgaacgatgacgcattgcccctgttcggcaagatgtagcccttcgccgatacagtggccatgacagtaacccgcacgttgaagatgcttcgctacggtataggttcgctgccagatttcatcttccagcgataactgtcgcgtgttgtgccagatctcacgctgtaacgccggtaaaaatcgtgcggacccaagcagtaaaatggaacctatcgccatcgccagcacaacctccagtagcgagaacccccgcgtggttattgacacgtggcggcctcgttacgctcacatagcctgattcgcccccaggaggagacgaccagacgccactctccggcagcgtttttcagcacgatgtgccctgcccatgccgtattgcgcaggccaaagaaggctaacgacggcgtgatatcggcaaggacgacatcacgccagtcgggcgtaaacacaaagggggaagatggcgtacacgatgtttgcgtagcaacagagctgacaaagcaccatgaaccgccttcgctgaccacgcgaagaatgtgatcgcggttatgccagtgagcgtcctcacgaagttgcagcaggtaatcccgcacctgacatgcggtttgccacaggcgctgttgctgctgccagcgttgccagccataaagtcctgtggcgctgagaatgataatgagcgacatcgcgaccaccgtttcaatgagcgtatagccctgttgttttttcatgtcggcagtatggcgggcggaagaaaaataacgagcgccaaatacagattgttcgacgcgttacggaaaaaagttcatgtcttgcagcgcgttgcaaaatttcgggaatccgcgccgaagattgagacaaagggtaaataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaaccgacgcgcgatggcgtcggttatggcaggatcgtcagcgcttagatagcgaccggcgctttaataccggggtgcggatcatagccttcaatttcgaaatcatcgaaccggtagtcaaaaagcgaatcgggtttacgcttaatgaccaatttcggcagcgcgcgcggttcacggcttaattgcaggtgcgtctgctccatatggttgctgtacaggtgcgtgtcgccgccggtccagacaaaatcgccgacgtccaggtcgcactgttgcgccatcatatgcaccagtaacgcgtagctggcaatgttgaacggcagaccgaggaacacatcgcaggagcgctgataaagctgacaggagagttttccatctgcgacataaaactggaaaaaggcgtgacacggcgccagcgccatcttatccagctcgccgacgttccacgcagaaacgataatacgacgagagtccgggtcgtttttaagctggctcaagaccgtggcgatctgatcgatatggcggccatccggtgttggccatgcacgccactgcttaccataaaccgggcctaaatcgccgttctcatcggcccattcgtcccagatggtgacattattttcgtgtaggtaagcgatgttggtatcgccctgcaaaaaccatagcagttcgtgaataattgaacgtaaatggcagcgtttcgtcgtcaccagaggaaagccttccagcaggttaaaacgcatctgatggccaaaaatggaaagcgtgccggtgccggtacggtcgtttttctgtgtgccttcatccagcactttttgtatcagttctaaatactgtttcatggttcctcaggaaacgtgttgctgcgggcggcggcgatatgcccaaaccatcatgatcgcgccagcgataatcatcgggatagagagaatctgccccatgctgatgtactgtacccacgcgccggtaaattgcgcgtccggctggcggaagaattcaacaatgatacgaaacgcgccatagccaatcaggaataatccggagactgcgcccatcggacgcggtttgcgaataaagagattaaggatgataaacagcaccacgccttctaatgccagctcatacaactgggaagggtggcgtggcaatacgccgtaggtatcaaaaataggctgccattgcggatgtgacggcagcagcgcaatatcttccgcgcgtgagccaggaaagagcatggcaaaccggaagtcaggatcgacgcgcccccacaattcaccgttgataaagttgcccagacgcccggcgcccaggccgaacggaattaacggcgcaataaaatcagacacctgaaagaacgagcgcttcgtgcgcctggcgaagataatcatcaccagtatcacgccgataagcccgccgtggaaggacatgccgccgtcccagacgcggaataaatagagcgggttatccagaaacagagggaagttataaaacaggacatagccaatacgtccccccaggaagacccccaggaaacctgcatagagtaaattttcaacttcgtttttggtccaaccgcttcccggacggttagcgcgacgcaccgccaaccacatcgcgaaaacgaaccccaccagatacatcaagccataccagtgaagcgcgacgggcccaattgagaaaatgaccggatcaaagtccggaaaatgcagatagctactggtcatctgtcaccacaatttcttgttatttcgctgaagagatagcgattgataagcgcgcctgcgcgttgcagacgctccaaaggtgcgaataatagcacaagggttaaaagcgagatgccgattaccgttaaaagatatgtatacgcattgtctttcatcttgcaggcgtgttgtctgcgccgtgaatccacagtcactttttcccgctccagtcgttacaaccctccgcgaatcaatccccccatcccgcggcgctccataaacgccgccacctgatgacgcacttcggtcgccatctgcgcctcaaggctgcgtctggcaagggtttgcgcgtcttcaaaatcgatatgccgcagcagatatttcacacgcgctaccgaacggccattcatcgaaagatggcgatatcccagaccgataagaatcgccacgcacatcggatcgcccgccatctcgccgcacaagcgaagatcgagaccatgtttttcggcttcctgcgcgatcatggacagtgcgcgcagcatagccggatgcaaactgtcataaatactggccacgcgggtattgttgcgatctaccgccaggatatattgcgttaaatcgttggtgccgaccgagataaagtcgatccggttagccagatgcggcagcataaataccattgatggtacttccagcataatgccgatacgcggtttcgggatcgcatagccgatcatctcctcgacctcgcgcccggcgcgttcgatcagacgccgcgcttcatcgacttcatcaatactggtgaccatcggcaacaaaatgctgaggttgccagtcgccgcattggcacgcagcatcgcgcggacctggatcaaaaagatctccggctgatccagcgtaatgcggatcccgcgccagcccagacacgggttctcctcgctgatcggcatatagggcagttgcttatccgctcccacatccagggtccgcagcgtcaccggtttatcgttaaacatttgcagcatcccttgatactgcgccacctgctcttcttccgagggaaacccgctttgcagcatgaagggaatttcagtacggtacaggccgataccgtcgatccgactgcctaacttttcctcatgctcggggctgagcccggcattcagcatcactttgatacgctcgccgcttttcagttgggcgggaagattgacgtcgtcctccgccagacgactgagttctatctcttcactaatgagccgctgatattcctgaataagcacgggttcaggatcgaccagtaattcaccgcgatagccatccaccaccaacgtacggcgatgtagcaccgaaggctggatatccgcgcccatgacggtggggataccgagcgcgcgcaccataatcgccgcatgcgagtttgccgcgccgtcgcgcaccacaacgcccgccagcctgtcctgcggcagctccgccagggtggtcgccgacagctcatccgcgaccagaataaaacgttccggccaggcgtttggcccctgaactgaatcatcaagatggaataacagccgctgccccagcgtgcgtaagtctcccgcacgttctttgaggtagttatcggttagcgccgcaaattgctcggcaaatttttcgatgatttttttaacggcccactccgcaacagcgcctttgtcgacctcggcgaagagttcgcgacgcagtctggcgtctgaaagcaggtgtgagtacagatcgaaaatggctgccgtctctttttgtgcgccggcggcaaagcgtttgctgtatcgtcggaattcgttcgccgcctcttccagcgcgccggtcaatcgttcgcgttcaagagaggtatccagcgtagacgcttcgtaaacctgttccatcagcggcatggtcgcgtcttgccagcccgttgcgatagccacgcccggcgccgcaggaagcgcgcgaattcgcgtctgccggtattgcccgaatagcgctgtgacctgcgactgtgacaggatagccgccatctgcgtagcgagcgtgacgaggaaagactcttcgctttcatcgtactggcgcaattcgcgctgctgcacgaccagcacgccgagaagttggcgacgctgaatgatcggcacaccgagaaacgcgcgaaaacgctcctcttttaccgaaggaatgtatttaaagctgggatgtttttgcgcatcggcaaggttaatgggttccgccagcctgcccaccagaccgacgatcccctcatcaaacgcaagcgcaacggttcgaccacgcggttttttcaacccccgcgtcgccatcaggtaataacagcgtcggtcatgatcggccaggtaaaccgagcaaacctctgtatccatcgcaagacagatatccgtgaccagaatattcagcgcctcgttcagacgcggcgcactggccactttttcgactatttcgcgcaggcgagtgagcataatttgcgtggcttaacctcttttacgtcgataagcaggcgcgctttgtagcttagggggattatcctgaagcgccatgacaacacttgcaaactctttcattaccctgcggtagacatcgcgtttaaatgacaccacttgtcgaaccggataccagtaacttacccagcgccagccgtcaaactccggcgtactgctggtttgcatattgatttcggcgtcggcgctcattaactgcaaaagaaaccacttttgtttctggccgatacataccggctttgtgtcccaacgcaccaaacgttttggtaacttgtaacgcaaccagttgcgagtagaagcaaggatccgcacatctttacggcttaacccaacttcttcaaacagttcccggtacatcgcctgttctgccgactcccctggatttatcccgccctgcgggaactgccaggagtgctgaccaaatcgccgggcccacatcacctgcccctgacgattacaaattacgatacctacatttgggcggtagccatcgtcatcaatcaccggactacctcaacataaaccttatatatgaacgattgtttcatactccagtgaggcggtaaaccactctgtaatagtgacacagcctaataacaattgaataactcacagtaaatagccgagttataaacagatgatgacgcccttgcgccattttattcaccttttctgtggatatagttgtgaagaagtatggaattaccacgggaaaacccagaacagtctgaattcctcatactgaaaacagtaaaaatagtgccttatattcattgtgttatagacaaatcttacatgccaccttcataaagcgtgaccagcatcacatctaagatccttatgctgatgaaagatcaaccagcgtcggttttatccacagattgtgccaataacttacgcactatttgtctgaattttcgattttcgtcgcacgtcaaggctgtaaatggaaacagtagtggtggttttacacagttatcccaactttctgtggataacatagtgtaagatcctgtttattgttagtgaccagaattggaaaacccgcttcagcgttgcgcaacacgaagaaacaacacaaaaaaggcaataaaaatcagtctattgaatataagacacagaaaaagataaactctgcccatacggtataaaaacactgctcattttttgacctaaggtaattgtcatgtccgctctttgtccgctactgactccgcctgcttcggaagcattgctgttagcccaggcgcggcagctttccggctatacgttaggcgagctggcggtgatggccggcattaccacgcctaaagatttgaagcgagacaaaggctggatcggcgtcttgctggagatctggctcggcgccagcgccgggagcaagccggagcaggatttcgccgcgttaggcgtagaactgaaaactaccccggtggatagtctgggtcgtcctctggaaacaacctttgtttgcgtggcgccgttaaccggtaacagcggcgtgacctgggagacaagtcacgtacggcataaattgaagcgcgtgctatgggtgccggtcgaaggcgatcgcagcataccgttagccgaacgccgcgtaggttcgccgctactctggagtccgagtgaagaagaggacaggcagctacgcctcgactgggaagagctgatggacatgatagtgctgggccaggtggaacgcattaccgcccgccatggcgaagtcttgcaactgcgacccaaagccgccaatgccagggcgctcaccgaggctatcggcgcgcgcggggaacctattttgacgctaccgcgtggattttatctgaaaaaaaattttacgcaggcgctgctggctcgccattttttattgcagaatccgtaacgtccattacacgcaaatgcgcctccgctatggctacgcgtcgggccgacgccggataaacgtaagcgtattgtcgccgctattttacaccgttcctggttgcgcaaattcagcctgggctttcgcccgtcactcgacgggcctataattaccgcttctttttttggcaggactttgttcgatgttatttgcatggataaccgatcctaatgcctggctggcgctcggtacgctgacgctgctggagattgtacttgggatcgacaacattatttttctttctctggtggtagcaaaacttcctacggcgcaacggaaccacgcacggcggcttgggttggcggcggcgatggttatgcgcctggcgctgctggcgtcaatcgcctgggtcactcggctgactaatccgctgtttgagcttttcggcgaagcgatttccgcccgcgatctcattctgttactgggtgggttatttttaatctggaaagccagcaaggagatccatgagtccatcgaaggcgaagaagaagggttaaaaacccgggtttcttctttcctgggcgcaatagtgcagattatgctgctggatattattttcagccttgattcagttatcacagcggttggcctctccgatcatctgtttattatgatggcggcagtcgttattgccgtgggtgtcatgatgtttgcggcacggcccatcggcgagtttgtcgatcgtcatccgtcggtaaaaatgctggcgctctcctttctgatcctggttggctttaccctgattctggaaagtttcgacgttcacgttccgaaagggtatatctatttcgccatgttcttctctatcgcagtagagagcctgaacctgttgcgtaataaaaagaatccgctgtaatcctgtctcgctcccccgccgggggagcgaatactcactttatttcctttcttctcacagattaagattttgctgcttccgacatgcagagctgcgcgttattactagactattatcagacatatgattaacagactattatcagatgcaggctacgtgaggaaaaacggatgaaaaagtgggcagttgtaatttccgcagtagggttggcttttgcggtatccggatgcagcagcgattatgtaatggcgacgaaagatggtcgtatgatcctgaccgatggaaaaccgcaagttgacgatgataccggtctggtcagctataccgatacacagggaaacgagatgcaaatcaaccgtgacgaagtgtctcaaatcatcgaacgttaagcggtggcctgtgatcgaggtcagcgttctgcaagccttcaggctgcgtcccgtaacggtgcgtggcgaccacgcccggtaacaattacgccgtgcagcctgcaattttactttcccttttgccttccctctgccatttttattgtcctttgtcgggaatttctgacttcataataaaaaggaaacggctatgcactatcaccgtataccccacagctcgctcgaagtaagtacgctagggctgggcacaatgacatttggtgaacaaaacagcgaagccgacgctcacgcacagctcgactataccatcgcaaatggcattaaccttatcgacgccgccgagatgtatccggtaccgccgcgcccggaaacacaagggctgacggagtcctatatcggtaactggctcgccaaacgcggcaaccgtgaaaaactgatcatcgccagcaaagttagcggaccggcacgtaataatgatcaaggcatccggcctcatcaggcgctggatcgtaaaaatattcgcgaagcgctacacgacagtttgacccggttgcagaccgactatctggatttgtatcaggtgcactggccgcagcgccccactaactgcttcggtaaactcggctataactgggcggactccatgccagtagtaagtctgctggagacgttagacgcgctaagtgagtttcagcgagcgggtaagattcgttatattggcgtttcaaatgagacagcgtttggcgttatgcgctatctgcatctggcggaaaaacatgacctgccgcgtattgtcactatccagaacccctatagcctgttaaaccgcagctacgaggtcggactggcggaagtcagccagtatgaaggtgttgaattgctcgcctattcctgtctggcgtttggcacattaaccggtaaatacctgaacggggccaaacccgcaggcgcgcggaataccttgttcagccgcttcacacgttacagcggcgaacaggcacaaaaagccgttgccgcctacgtcgatatcgcgaagcgtcacaatcttgatccggcgcagatggcgctggcctttgttcgccgccagccgtttgtcgccagtacgttactgggcgcaaccacgatggcgcagctcaagacgaatgtggaaagtctgcatctgacgttaagcgaagaggtcctggcggagatagaggcggtgcatcaggtttatacctacccggcgccgtgatggtcagtgcccggtggcgctacgcttccgggcttacagagacaatgtaagccggataacgcgcactcgccgcccggcatattcactcagtatgatgcctgccggcgctgccagatccacagcgccgcgatcgccagcgcgaacagcacgccaaagccgatacctatcgccactgccggaacgccaaccagcaccgccagcgagtacagtcccagcattaatagcatggcgctattctcgcccagattttgtacggcaatggcattcccggcaccaacgctcttcttaccgcgctcctggagcaaagcgttgagcggcaccacaaaaaagccgcccagcatacctatcaacaacaacaaggcataagcaggcagcaatgcgtgctgtaatgagaagatcgcaaccacaacgccaatcaaaatcccagcgggcatacagcgcgatacggtctccagcgtcaccagttttgccgccgcacccgcgccgaccacaatgcctaccgccaccatggcgttcaggtaagtcggcgtggcgttatccgtaatgcccagcgccaccggcacccacagcaccagcagaaaacgcagcgtcacgcctgcgccccagaatagcccggtccccaccagcgaaaaacgcgtttcaccgttacgccaaaggacaacgcaagcgcagaagaagctacgcgtcatcgccgacaaccgccaggattgtcctggacgcgccgccacaagcttcgggataaacaggttcgccgccactgcgccagcgtaggccaacgcgcaggcaaccagcgcggcgatgacatgccagtcggccaatacgccgcccgcgacggaaccgagcaaaatcgccgcaatcgtagaggcttccatcaggccattggctttcaccagcttatcgcccgtcgtcagttcgcccagaataccgtatttcgccggagaataagccgccgcgccaatcccgaccaacgtataaccgacaaaaggatttacgccgaggcagatacctgccgctcccgccagtttaagaccattggcgaccatcatcacccggcctttggcaaagctgtccgctatctggccgacaaacggcgcaaaaagaatgtaagcgcccacaaacaccatttgcaaaacaggctggctccagtccgggtaaaactgagctttcagcagtgccagcgtcgcgaacagcagcgcattatcgccaaaagccgagagaaactgcgcgacaattaccgacagcatccctttcgaccagatggaggtgttagtacgtactgactcactcatgatgttgttccggcgcatccacccaacttttcagcgtcacaaaatcgggtttcccgctgccaagcaagggaagctgtttcagataacggatatcacgcgggacggcaagttccggaataccgtgttcacgggcatagtgctgtaacttttctcgggtgagttcgctgtcagtcgtaaacagtaccagcgcttcacctttgctggcatcgcttttaatggcggtagcgtgcattttctccgccgaaacgccaagcgccagttgctcgaccatctccagcgagaccatttcgccagcaattttcgcaaagcgtttcgcgcgcccctgaatctgcacaaaaccattttcatcgaagcgtacaatatcgcccgtgtcgtaccacccgcgctcggtttcgcctctggcgttttccgccgacggcacctccagcacgcccggtttttccacgcgcagatagccattcatgatattcggccctttcagctgtagccgaccgccgttttcaataccgggcaccgccagcagacgcgcgtccatgccaggcagaatgcggccaacagtgccaggcttagccgccatcggcacgttaatcgagactactggcgcgcattccgttaccccgtagccctcaagaatgcgcagaccgaatttatcctgccacagttgcttggtgctctcctgaagtttttccgcaccggccaccacatagcgcaggcgataaaaatcatacggattggcaaagcgcgcatagttgccgaggaaggttgatgtaccaaacagcacggtacagttacggtcatagaccagttccggcacaatgcggtagtgcagcggacttggataaagaaacacttccgcgccggtcaacaacggcgtaaacaggcccaccgtcaaaccgaacgagtgaaagagcggcagcgccgacataaaacgatcattggcggtgaaatccgcaatcgtttttatctgctcgacgttcgccagaatacttttatggctgtgcaccacccctttcgggtgcccttccgagccggaggtaaaaagaataatcgccgcgtcttccggctgctgttttacctgcgccagtcgcggcgccaggaggtgggcaaaaatccacagcttgtcggcgggtgtgacgtccgcttttaaatcttccaggtaaacccagcgaacctgcgttagctgctccggcaggtgccacaatttacctttatcgaggaactggcgggaggtaaaaatcgttttaatttccgccgcggtaatcgcgctggtcagcccttttacccccgccgtgtagttcatcatggccggaatgcggcgacgagaaaccgcgccgaaaatcaccgccgcgctgatggcggcattcggcagcattaaaccgattttctcgccctcaacgctgtacttttccagaatccggccaacaaaaagcgtcttggtcagtaacttacgatacgtatccggcgtaaagttaatgtcctcaatacagtttttacccgcgccgtaacgatattgcgccgccagcaacgattcgtataacgtctcgcgcgggcgcactgccatacgcgcttccatcatgatctggtgcagcatctcacccgctatcttacgtctgtcgcgcgcgcgcggcgcttccggcatcggtatttgcgtcggcggtaaaatatgaagctgaatgcgggggaataagcgccgtttaaccagacctttcaggcgactgaaaggggtaagctccgcgccgtcaatgcggagcggaatgacggttgcgcccgattttgccgccacaaagcctgcgccgtcataaattttcatcagcgagccggtcacggaaatccgcccttccgggaaaatcaccactggacgcccctgctccaccagacgcaccaggtgtttaatggacatgggtttagtgggatcgagcggtacaaaatcgatcagcggcgttaaccagcgcatataccattgctggctgatggaggtatataccgcaaagacaggccgtaccggcaaaaacagcgccagtagcataccatcgataaatgaaacgtgattgggggcaattaagacccggttcccctgtagcgcccggacatcgccagtgacgcgcacacgataaagcacgcgaaacaggttacggaaaaatccaaacagcatttcaactccctttggccgacaattcgctaaaacatgaattgtggcagattacacgagttgcgtaacaggagcgatagcaaaataggttcgaataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaaacctgcgcatccgcgcaggttggtgcaagagacaggtacgaagagcgtaccgaataatctcaccaatcaatacctctgggatcttgattgtgggcttcgcgcgtctgcatcgccagtccgaaaacgcaaaggaataaacggaaatgcaacgagttgtgtaaattatccgttactgttacaggttcaggcgaaacaaaaaaaacctgcgcatctctacgcaggttggtgtaattcgtgtgatcaacaatgacgttgattccacctatcaatacctctgggatcaccactctatcaacctgactcgctggcctgccagcagacaatcgcaacagcgcttcgcaaactgtaacgaaagatttgtattgtcactttacagacgcatttctcccgtgcaggtcacatttgtccgacacggcggggcaagaggcttgaacagacgttcattttccgtaaaactggcgtaatgtaagcgtttacccactataggtattatcatggcgaccataaaagatgtagcccgactggccggtgtttcagtcgccaccgtttctcgcgttattaacgattcgccaaaagccagcgaagcgtcccggctggcggtgaccagcgcaatggagtccctgagctatcaccctaacgccaacgcgcgcgcgctggcacagcaggcaacggaaaccctcggtctggtggtcggcgacgtttccgatccttttttcggcgcgatggtgaaagccgttgaacaggtggcgtatcacaccggcaattttttactgattggcaacgggtatcataacgaacaaaaagagcgtcaggctattgaacagttgattcgtcatcgttgcgcagcgttagtggtacacgccaaaatgattccggatgcggacctggcctcattaatgaagcaaatccccggcatggtgctgattaaccgcattttaccggggttagaacatcgctgtgtcgcgctggatgaccgttacggggcatggctggcgacccggcatctgatccagcaaggtcatacgcgtattgggtatatctgttccaatcacactatctctgatgccgaagatcgcctgaggggctattacgatgcgctggcggaaagccatatcccggctaacgatcggctggtgacgttcggcgaaccggatgaaagcggcggcgagcaggcgatgactgagttattaggtcgcggcagacattttaccgcggtggcctgctataacgactcgatggcggccggcgcgatgggagtattaaatgataatggcgtgggggtgccgggcgaagtatcgctcatcggttttgatgatgtactggtctcacgctatgtgcgtccccgactgaccaccattcggtatccgatcgtcaccatggcgacacaggcggcggagctggccttagcgctggcagggaaatgccctacgccagaagtaactcatgtatttagtccgacactggtacgccgacattcggtgtccacgccgacggataccgggcacctgtcgacaaccgattaatcagggtagcatgatggcgacaatgctggatgtttcccgccatgcgggcgtatcaaaggccaccgtctcacgagtgctgaatgggacggggcaggtaaaagaaagcacgcgccagaaagtgtttacggcgatgcaggctctggactatcgccccaacctgctggcacgctcgctggcaaatcgcaccagcaacagcatcggtctggtcgtctctacgtttgacggcttctattttggcagtttgttgcgccgggcgtcgcgccaggcggagtttcataacaagcagttgatcgtcaccgatggtcacgatacgccggaacgagagcagaaagccgtacaaatgttggccgacagacagtgcgacgctattattctttacactcgctatatggatgagccgacgattttgtcgttgattgacgccacggaaatgccgctggtgattattaatcgcaacatcactcaggcccacgatcgcgctattttcttcgagcaggagacggcggcattccaggcggtggaatacctgattacgcagggccatcgcgatatcgcctgtattacgctgcctgttcatactcccaccggcacatcacgcgtagcgggttatcgaaaggcgctggaaaaatatggcattccctggcaaccggcaaaagtgaaatacggcgattacacgctgacgcgcggctatgacgcctgccgggaattactggaggaaggcgtcacgtttagcgcgctattcgcctgtaatgatgacacggcgctgggcgcggcaaaagcgctgcgccaggccggattacgcatcccgcaggatgtgtcgctgtttggttttgacgatgcgccgggcgcaacctggcttgagccggggctttcaacagtctatttacccatcgaggatatgatagccaccgcaattgatcaggccgttcgtctggcgaacagcgagccggtcgccccgatcccgccctttaccggcacgctgattctgcgcgagtccgtcgccgcgggcccgttttttcaacgtccggtctaatgatgcgcttcagagcatctccagcgctaacagctcttcaatggtttgacgacggcggatcagccgcgcctgtccattgtcaaacagtacttccggcaggagcgggcggctgttgtaattcgatgacatagacgcgccgtacgcgccggtatcgtgcaatacgaggtaatcgccggggatgaccgcaggtaaggcgcgtgtttcaaccattcccccttcctgctgcgtaaaaacatcgcctgattcgcatagcggcccggcgaccaccgtctcgacccacgggccattttcaagcgcgcgaccatccgccgccagcgccgaaatacggtgatagctaccgtacatcgccgggcgcatcagatcgttaaaaccagcgtcgaccagcacgaaatggcggcttcccatctgttttacgctacgcacctgcgttaccagcacgcccgattgcgccaccagataacgtccgggttcgatctcaagtttgaccgcatgtcccagatggcgggcgatttgctcgcgcgccgcgttccacagaccatagtaatggcgcgtatcaacgggctcttctccctcatgataaggtatcgagagtccgccgcctgccgaaatcgcctccacatcctgaccacattccagcacctggcgtaccatcgcgccgcaaacctgctccagatggccataatcgacgccggaaccaatgtgcatatggataccgacaagtttcagtcggtatttctgcattaccgccagcgccgccggaagatcgctatgccagatgccgtgtttgctgttttcgcccccggtgttggttttctggctgtggccgtgaccaaagccaggattcacgcgcaaccagacgcgatgcccaggcgaaacctgaccaagctgcgtcagcatatctaccgagccggcattgaccggaatatgcagttcactgacgcgcgccagcgtggcggcgtcaatcacatcggcggtaaaaacgatatcatcagggcacgtttgcggatcgtagcccgccgccagcgcacgttcgatctcccccaatgaaacagaatccaccttgacaccctgcgcgcgcattaagcgcaggatatgaatgttcgaacaggctttttgcgcaaaacgcacgacgtcaaactgctgcagggcggctatctgacggcgaataatgtgcgcgtcatagacccagaccggacagccgaattcagcaggcaatctgagcaaattttcagcgttaaggtcagtttcagcgtgataatgcggcaatgacataacaaactccggaacaggctttttaacgattacgccataccttagaaagaataaaaaatatcgttttattgtcagtctatgcaaaaatgatatgggataaatgattcagggaaacgtatggctgccgttaatttacgtcacattgaaatttttcatgccgtaatgaccgccggaaatctcaccgaagcggcgcggctgctgcatacctcgcagcctaccgtcagtcgcgagctggcgcgttttgagaaagtgctgggattaacgctgtttgagcgcacacgcgggcgcttacatccgacggtgcaagggctacgcctgttcgaagaggtacaacgctcctggtatgggttggatcgcatcgtcagcgcggcggaaagtctgcgcgagttccgtcagggcgaactctctatcgcctgcctgccggtcttttcacaatcctttttgccgccgctactaccgccttttttggcgcgttatccggatgtcagcctgaatattgtgccgcaggagtcgccgttgctggaagagtggctctccgctcagcgccacgacttagggctgacggagacgcttcatgccccggcaggaacaacccgcaccgagttactaacgctgaatgaagtgtgcgtactgccctgcgaccatccgcttgccgccaaaacggtactgacgccagacgattttcagggggaaaactttatcagcctctcccgcctggacagctatcgacagttgttggatacgttatttgccgaacatcaggtgaagcgcagaatggtggtggaaacgcatagcgcggcctccgtctgcgcgatggtgcgcgccggggcgggcgtttcgatcgttaacccgctgaccgcgctggactatgccgccagcggcgtcaccgtccgccgcttcagcattgacgtgccctttaccgtcagcctgattcgcccgctacaccgccccgcctccgcgctggttgacgccttcagtaagcatttacaaacgcatctttcgcgcctggtcgaaccgctggaggttattctggggccgatgacgaaagcataaagctcacggcatctgcggcatgaattgccgtggtatcgaaaaccggtagcgcgctttgcgtctggggaacaagcaaacctatttcagtacagccaaaaataacgccctgcgcgccttgcgcagccagttgttcgataacctgtaaataatagtggcgcgacgcgtcagtgaatatcccctgacagagctcgtcaaaaatcacctgattgatacgcgcccgatcgtccgcctccggcacgatggtctcaatcgcaaattgctgttccagccgcccgcgataaaaatcctgctccatcgtatagcgagtccctaatagcgccacgcgatgcaacccctgacgggcgatggctcgcccggtagcatccgcgatgtgtaggaaaggcagagaacaacgagattcaataatgtgcgcgattttatgcatggtgttggtacacagcacaataccttctgcgcccgcctgctgtaacccctgcgcggcctgcgccaggatatcgcccgctttatcccattcgccgcggcgttgacatacttcaatatcgtggaaatctacgctatgcagcagtaagctcgccgagtgcaggcctcccagctgctgtttaatgccttcattgattaaacggtaataagggatagtcgattcccagctcatcccccccaacagcccgatcgttttcactgcgctctcctttttgtaaagcattatggcagtgaaacaaacttacacatccgtttccagtctatttttcatcatgccggataacaggcgtcatccggcatgggaggggggattacacgccaatatttcttagcttctcgcccgccattagcttgcgttcgatgtgctccagggtgacatttttggtttccggaatcagccagaaagtgatgccgataaaagcgatattcagcgcggtgtagagccagaatgtacctgccgcgccaatgctgtccaacagtgtcaggaatgtcgcgccgatgatcatgttcgatacccagtttgtcgtggttgaacaggtaatgccaaaatcacgacatttcagcggctggatttccgaacacagtatccacaccaccggagcggcgctcatcgcgtaaccggcgatacacatcatcgtcatcccaacggaaagccaggagagaccgcttgatgccgtaccgttatcaaactgcatcaggcagtagcccaacaccaatgtccctaacgccattacgctgaaaccgatttttaacgccggtttacgcccggccttatcgaccgtaaagacggcgataaaagtcgcgaacataaaggtcagtccgaccaccagcgtagcgatcatttgctgttccgtggtggtaaagccggccattttaaaaatgcgcggcgcatagtacataatgatgttcatgccggtgaactgctgcattgcctgtagcaacataccgaggaacacggcgcggcgaacattacggttagctttaaataatgcccatccgccctgcttgagtttgaggctttcccgaatctcattcagttcatcacgggctttttccgaggtatcgcgcagcatacgcagcacctcttccgcttcgatatggcgacctttttgcgccagccagcgcggactattcggcaggaataccaccagaataatgagcaacaccgcaggcagcgccagcacgcccaacatcgcgcgccagttgccgctgtagctgaatgccgtatcggataaaaaagccagcacaatgcctaacgtcaccatcagttgatacatactgatcattttaccgcgaacattttcgctagccatttcagagagataaagcggcgcggtataggacgcaatccctactgctacgcccagtatcacgcgggcgccaatcaatacttccacgctggaagcaaacgccgaccccagcgagccgagcacgaacaaaatcgcgccagccatcaggctatacttacgccccagccgaaatgaaagccagccgttaaataatgcgccaattgccgcgccaagcatcatactgctgacgacccattcctgcagccggctggtcagtacgaaatggtcggtaataaaaggcagcgccccagcgataacgccgatatccagaccaaataacagtcccgctaccgctgcagaaaccgaaacaaacatattcatacgtcgtgtgtcgcgaagcgaacgcggcgttaaagcagagtcattaatagagaccatattttcctgccaccacagagtaagacatagcctgaaagtacgggatactcttcctcaagtgtcaggctggaaacggcataaatatggattaaatggctacgctatagcgatatgtgatggatattacactttttaaatttaacgccgttgccgggtattttttcaaaccaccaatatttcaataagttaaaccatttatcatagctattatttaacaatatatggattaagttaaacccacaatatggactatgctaatgagatcataaaaaaaccctgtacgaggacagggctttatcagttttttcggccaaagagtcgattttcccagaaacgcatttgtcagtagcggattaacgcgccagccaaccgccatctaccgctatggtatagccgttaatataatcagcggcgctggatgccaggaagactaccggccccattaaatcgcccggtagcccccaacgtccagccggaatacggtcgagaatttcggcgctacgttgtgcatcagcgcgcaattgctgggtattattcgtggacatatagcccggcgcgatggcgtttacattgatattgtgtttcgcccactcgttcgccatcagacgcgttattcccattacgccgcttttcgacgcggtataagacggaacacgaatgccgccctggaaggaaagcatagacgcgatattaataattttgccgccgttgccctgggcaataaaatattttgccgccgcctgagacataaagaacacgctcttgatgttcaggttcatgacgtcatcccagtctttttccgtgaaatcaatcgcatcttcacgacggatcaaacccgcgttattcaccagaatatcaatatgaccgtattccgccaccgcccgttccagtagcgccggaataccatcgatttgacgcagatcggctgtcaggcttaaaaaacgtcgtcccagagcggtgacgcgcgcaatagtttccgtcggttcaacaatgttaataccgacaatgtcacagcccgcttccgccagccctaacgccatcccctgtcccaatccggtatcgcaccccgtcacaaccgcgactttaccttcaagagaaaatgcattcaaaatcattgttaatccttatttttgtcatgcctgtcacacaggcgttatcaccggtcgcgactagcgcagatcttgtaccgcaacgtgatccatgtcatcgaagacctgattttctcccaccatgccccaaataaacgtataggctttggtgccaacgccggaatgtattgaccagcttggggaaataaccgcctgttcattacgcatcacaatatgacgggtttcctgaggctgccccatcatatggaaaacgcaactgtcctcttccatattgaaatagaggtaaacttccatacggcgctcatgggtatggcatggcatggtgttccatagattgccgggcgccagttcggtgagtcccatactgagctgacaggtttccagtacatccggtacgaagtatttattgatggtgcgacggttactggtgaggttatcgcctaaggtgacgggcgcaacgtcggcaggcgacacttttttcgtcggataagcggtgtgcgctggcgcgcagttgtaataaaacttcgccggtctgctcgcctcattgctgacgaagaccagctctttcgcccctttaccaatatacagagcatcacgatgaccaatgtcatggcgctgcccgtcaacgataatggcgcccgcgccgccaatattaatgacgcccagctcgcggcggtccagtaatcgggaaacgccaagctgtttacctacttctccgccgatttcaacgggatggctgacgggcataatgccgccgacaataatacggtcgatatggctgtagaccatcgtatattcatcagcgacaaaaatattttctattaaaaactcgcgtcgcagcgcctgggtgtccagcgttttagcgtgctcgctatggatactttgccttacgtccacttttccctccaatgataaatcgatcgcaacggcataaaatcaaaacactgttttgatttatttaacggcatcatagtcgcctggataaaggttttcaacaataaataaaacaacgtttcatttttatgtctggttatttttaaaactgctgtagcgatcacgatcggcgctaaaacttacgcatttgtctgattttcagacatgcgcgccagatgctgtatgcggttacccagataaaaattggagcttgttttagaacgaggtctgatgtgcgaattgaattaaaagcggtacgcgtctgcaatgcccgccgcggcaagaagttctgcgctataacgaaaaaggggggtctgtcactggctttgccctcgtgatagagggctttttatgacggaatactgaagcaggaaaagggtggctggcgtaggatcagtcgcgttcaatggttaaagcaacgccctggccgccaccgatacacagcgtcgccagaccttttcgcgcgtcgcgtttaaccatttcgtgcaccagtgaaaccagaattcgacaaccggaagcgccaatgggatgccccagcgcaatcgcgccgccattaacgtttacccgtcgctcatcccattccagcatttttcctaccgacaacgcctgggcggcaaacgcttcgttggcttcgataaggtcgacctccgtcagttgccagccggcacgctccagacagcgccgggtagcatataccggcgcaatccccattagcgcaggatcgacgccgacgctggcaaacgcgcggatgcgcgccagcaccggcagccccagcgcctgggctttcgtctcgctcatcatcatcaccgcggcggcgccatcgttgattgaagaggcattacccgccgtcaccgaacctaaactatcaaacgccggatgcagcagggctaacccctccgcactggcgtcggcccgcggttgttcatccgtatcgacaattgcggtctgcccattacgttgcgtgacgatggggacaatctcatctttaaaacgtccggtatcaatcgcggccctggctttttgttgcgaactgagcgcataagcatcctgtaactcgcggctgatgccatattcccgcgccaggttttctgccgtcacgccaatgtgataatcgttgaaggcatcccataagccatcatgtaccagactatccaccagattgtcggcatcaggcaacgcgccggtacggctgtcattgaggacatgcggcgcacggctcatattctcctgcccgcccgcaataacaatgtccgcttcgccgcactgaatagcctgcgtcgccaggtgcaacgcttttaaaccggaaccacaaacgtcattaatggtaatagcggaaacggtagtcggcagccctcctttgatggctgactggcgcgccggattctgcccggcgccagccgtcagtacctgaccgaggatgacctcatcgatagcattagcgtccacgccggtgcgctcaattaacgcttttacgaccatactccccagctcgacggcggaatgacgggccagcgttccctgaaaacagccgatgggtgtccgtaaagcccccactatcacaacctctttcattaccacctcagcgcaaaatgacaccgccatagtagagcattgttaaaattagttatcttgattgtttaaaaaaagtgagttttatcacaaaggaaatgacgctgatttgacggtggcgcagcttatttctgctgtaaatggtagcgaagccagttccccgccgttccgggcggcgtcttcttgttccacaacaaatcaatagcaatcgccctcggccagccaggaacatccagctgcgccagcggtttttccgccgcaaactcttccaccagcgcgcagggcaatacgcaccagccaaatccctgaaccgccatgctcaacagcaataaatagtttggcgctgaccaggccgggccgcgcgtaatgttggcgttagagtcaaggtaggtattcagacgcagctcgcgccaggtatgcagttgctcccattgcaggttcgtctgcgacgccaacggatgcgtggtcgccacataaacccccatccagctttgaacaagcagacgcgtcgcgccaatgtctgtgggatagttatcacgcgcttcaatcaggcctatctgggcgcgccctttttgcagcaggtcgatgacatcatcattttctccgatcaaacattcaaactcggtatgcgggaattgacgatcaaactgcgccattaactcttccagactgtcagggtgcagggtatcagagaggacgaacgtgagccttgtctccgtctcgccggataacgtcagcgccacctcatccagacggtcgctcgccgataaaatagcctgaacatagctaagcacccgttttccttcttcggtcagaacgggctggcgcgatgatcgatcaaataatgaaaatcccagatccgcctccagatgcgcaatggcggtactaatggtggactggcttttacgcaggcggcgcgccgccgcagaaaacgagccgcaagagacggcctcaacaaatgccattaacgcttcaggtgagtaacgcataacctatctactttatcgatggattttatcttttaggtatcatattaaacgataaaatagcggaaatttctttaatttgattaagagtaaggttttttcatttatgcaacatgacgccatacaacgtcgctcgctgccggagcgtattttccatgctgtctgttttgaaggtattgcgactgcgatactggcgccaacgaccgcctggctaatgcagcgctcggtgctggagatgggcggcctgacgatattgctggcaacgacggccatgatctggaatatcatttataacgctctgtttgatcgactgtggcctgcgcatcaggtgagacgaaccgccaaagtgcgcgcactccatgcgttaggatttgaaagtgggtttattgtcattggcgtgagtattgtcgcctgggtactgaatgtcagcctgctacaagcattcaccctggaaattggtttcttcctgttctttttgccgtacacgatgctgtacaactgggcatacgatgttttacgccaacgaatagtgacccgccgccaacagcgcgttagtgcatgatattgctcttttttgccgggatcgcaacgctcccggccctcctcctccacgacatccatctgcttaaaacgcccccaactgacgctatttatggtaaattgcgcttctttttgtgtgttttatagttgataaattcaaataatgtctaaaatttggtcaaaagatgagactctctggagttttgcattatacggaacggctgtaggcgcaggcactcttttccttcccatccagttgggatcggcaggcgcaatcgtgctatttattaccgcgctggtcgcctggcctctaacatactggccgcataaggcgctgtgtcagtttattctttcctcaaagacttctgcaggtgagggaattactggcgccgttactcattattacggcaagaaaatcggcagtattattaccacgctttatttcattgcgttttttgtcgtggtattaatttatgctgtggcgattaccaattccctgacagagcaattagagaagcatattcagatagatattcgcatccggatggcagttagcttcggcgtagtacttatcctgaatatgattttcttaatgggaagacatgccactcttcgcgtaatgggctttttagtctttccacttatcgcttacttcttgttcctttcgctctacttaaccggaagctggcaaccctcgttactgaccgggcagatgtctttggatagtcacacgttgcaccaggtatggatttctattccggtgatggtttttgcttttagccatacgcccattatttcgacgtttgccatcgacagacgggaaaattttggcgatcaggccatggataaatgcaaaaagatcatgaaggtcgcctacctgattatctgcctgagtgtgctgttctttgtctttagctgcctgctctccattccgccgtcatacattgaagacgcgcgcaacgaaggcgttaccatcctttccgcgctctcgatgatgcccaatgcgccggcctggctctctatttccggtattatcgttgccgtcgtggccatgtcgaaatctttcctcggcacctatttcggcgtcatcgagggcgcaaccgaaatggtaagaaccaccctacagcaggttggcgtgaaaaaaagccgggcgttcaatcgcgcgctgtctatcatgctggtttccgggattacgtttattatttgctgtattaacccgaatgccatctctatgatttatgccattagcggcccgctcattgcgatgattctgtttattatgcccacgttgtcaacgtacctgataccggcattgaaaccctaccgttcaataggtaatttcattacgttggtcgtcggtttactttgcgtatcggtgatgtttttcggctaaagtaaaagatagccgggatataactcccggctattttatataagaatccagcacctttaatattacgtccagatcttcttcacgtctggcttcatcactctgatgaacgatatgctcggtcagatgccctttaatcacctcgcgcattaagccatttaccgcgccgcgaatcgccgcgatctgttgtaacacggccgcgcattcatgcggttcatccagcattttttttagcgctatcacctgcccctgaatcttgctggttctggctttaagcttttgtttgtcccggatggtatgtgacattacaacacctcactaacattaacgaatacaaattatagcattacgatgctactggggggtagtattccatactgggggggagtagaatgacgcccacataaaacaactaagaatcattctcatgggtgaattttcgacacttcttcagcaaggaaacggctggttcttcattcccagcgccattttattaggtattttgcacgggcttgaaccagggcactccaaaaccatgatggcggcttttatcattgccattaaaggtacggttaaacaggctgtcatgctcggtctggcagcaacgctttctcataccgcgatcgtctggttaatcgcgctgggtgggatgtatcttagccgggcattcaccgcacaatcagtggaaccatggctgcagttaatttctgcgatcattattctgagcaccgcgtgctggatgttctggcggacatgacgaggcgagcagcagtggctggcgggaaaccaccatcacgaccaccatcacgaccaccattacgaccatgaccatgaccatgaccatgaccatgaccatgaccatgaccatgaccatgaccatcatggtcacatacatccggaaggcgcaacgtcaaaagcgtatcaggatgcccatgaacgcgcccatgctgccgatattcaacgccgttttgatggtcaaacagtgaataatggacagatcctgctgttcggcctgaccggagggcttatcccctgtccggctgcgatcaccgttttactgatttgtatccagcttaaagcgtttacgctgggtgccacgatggtgctgagctttagtcttggcctggcattaacgctggtgacggtaggcgttggcgcggcgataagcgttcaacaggcagcaaagcgctggagtggtttttcgacgcttgcccggcgggcgccctatttttcgagcattctgattggtctggtcggcgtgtatatgggaattcatggctataccgggatcatgcagtaaatatgtaacgcttctgctcaggccgtatcattcacttcgggtttcattccagaagcgtttttacttatcaaacggtatgaaaggccatacattcagcgtcccgcctgaattctgtattttactccactacaccacaggcaaaacataccccaccgccaccgggtttagccggtgtgtcagtgtttctggatagggtcgccggaggcgggttattgcggagcgataaacggagttcgctgcagtgatttacaaaaccgggtaccaaacagcagttcccgtaatcggttccgcattcccagcttcaccagtaaccggtatttgtcctgccagatttgcttctcctgcgtgttcagccttccacacagcgctgataaccttccccgtccacggtaaacttcctgaagcaagcgtaactgggccaggctcactccgcatgccagtatctcccggtgcatcaactggtccatatagttcatcaaccgcttcggattgttaaatatcggtggcacttccagaaagcccgtcaccggatccggagataacaaaaaggcgtccagccctcctgtcctgcgcaggcgtgcgcccccggcccactgttcatcccgccgccaccgaataagtatctccgccagttcctgctccagcagcgccgggatgccgccgtataccttcagtaccacccggtcgctgaaaaacagctcatcgctgataatcataaccgggtagtccggcagtatctgcctcagggaatagaacaaaaagagatgttcacggggacgcagacacagtatcagtatggcctccggtttccgacgtaattgctgcaacagaacaggcagcctgtatgcggtttcacagttgcagcccggcagaaatctccggaccaggtgtgccacggcgatcgtcaccggccagcagtcaccgtaaacgataatctgccgggccggtatccggttatgttctgtcatcctcatcctccctctttttcaggatctttcccgcatttctgttactgcacagccggttccacagttcatttgccatcgacctgtcaccattaccgacccggcgttttgataccggcggcggtccggctttttcacggcgcgtggacggggtgggactgtcaagaacccggataacataaatctcatagcgtcgtgctttattgggcagggtctggtgacggcagatgctgaccacccgcgatgttttgcttcgcagataggcaatcaggtagctggcccgtctggccgtgatgtgaaacgcctctgctatctggttacgctgaacccagttctgctgcaacaggcaccagtgtgccacgatgatatacaggggctcgccggcatactggcggacacttaccggaataaaacaggcatcatggttggtctgtccgggataatgaatatcgttacctgggataaggtactgcttttttgcgtgtgtattatcagggcacataaaacctctccataactgggtaaataattttccggaggtgaagaacagctcttaaatagtatttattattaatgtgggtttattcgggattagttccccgataactcagtcagctcttttatttttattatctgtcacccccgattagttataggtaacagtaacgagtattgcagcagaaaactttcctgtctttacacttccccccagggtcggggttattactgcagtatataccttcgacacattaccggtgacagttcctgtaatagtaatatcccccagtacttcttgtttatcaaaagtaatctcttttcctttatcatcttttattgaaagccggagtccattaggctgacctttgttggggccatccagactgacaagattcagagtttgcccggtatcctgtgtcagcgcacctttcccgaaggtgatggccagcgggatcgcgaattcctgtcccatagccggtcgtaaaacctgcctggcgatcactgtaaaatttgcctgtctggtctgtgaaggttcataagtcgtataaatatgcccaaagttgacctgtaatggaacaatgtcaactttacccaatccgtttctgagaattctcacattaaaaccagataaaacaaatccgttttgtctcaaagaataaggaaaaggtacaatatttaaaacattacttatccccgtaaaagctgtaactgcactactctctgaatatgcttttgtatataagaaatccagtgttatccttacttttcgctctgtagttccaacaggtagttttgtgccaaactcttttcgtaactcatttcctgactgagtgctctttatttcatcccaggagaacgaaacaacatttgaaacattttctgtttctttaacggacattctgaatccaagtcccatcgcatctagtgtctgggtaaatttactgaagtagccctgattaaataccagctgtggaaattgcgtgccatatcccattgaacatttgaaaactgcatcctgattgattgaatagataaccgaatccgggccaggtttaaaatcatcggttgtcaaatttatacttcttaaattaatattctgaccagaagtgactacacattcatttatacctggctcaaccgcatacactttagtcacacataaagaacacaacatcatcaccagcacggtcagttttgttttcagattaaaaatccattctgtcatgatgtcacccctgcgtccttaaacgcgcagttcagggcatcacaggtgtagcggttcatctgcagtccaccataatcatctatataccccacccacagcgtccgggtttctgccggcagaacagcctttaagggcaggctccccaggggcggcaccatcacgccctcgcggaaaccgctgagcctgtggctgcggtctgctcccagccacgccacagtgatgtagtacggcgtcgggtttctgagggtcagatgtcccgcattccgctcagcagtcagctttctttccggctggtcactgctgcttctgataatggctttcggacggtaaaacagtttcagctggctctgcatggccagttgcaggacgttgtcgtcttctgacttcgggggaacgccccgcacgttaaaccagaacagcgtttccctgtcctgagggagcttgtctgtcagcccgcgaacctgggtgatacggacctgggatttctgtccggcatcaatacgctgcagcggtggcagcgctatcagcgcatccgttctcaccccgtcagcgtccgtcacccaggactgcgccaggaacggcgtggttttgtcatcgttattcagcgtgatggccaccgttttctgcggtgcatccatgataatacgggtccggtcgacattgacggctgccgggctgtactggctccatgctgccgccagtgcgagtaaaatcacacggcttcttctgctgtttttcacctgttttctccgttagtcctgctctgtgacagggatatttttatctgcagggcagtaacagcggcccccgactgagtgtcaccgtttccggcagggtgagtctgcactgcacccggccatcccagggcacgttcagggtccggcggtcttccccgctgagtccggtcaggtaggccagaccgtcatccccgaccatccccgcggttctgccggtttttccggacaccaccagggcgccaaacggtggactggcgccatcagccagccggatatgaccgagcacctgctccccctggctggcgtcaatcttccggtagcccaccgcgccctccgtcagcacctggctgatgacggagctgctaacgtccacgtcctctggcagggcggccacatcaaccgaaatatcgctgcgccgatagctgctgccggcgctcaccacgcccaccccgaagcggttggtcaccccgctgttgccgttcaccggtacaccggccacgtctccggtatctatcatcatgcgaggctcattcccggccatcgactggctgaaggcggcgccgtgggcggtggcggtcaccgagccgtaccagctcaggcccaggctgcggtactgtccgggctgcagggtggcgtccgctgccgcctggccccacggcagacggctctgcacgctgccgctgaagctgctgttactgccggtgtcatagcggttatgaccggcgctgatgttccatgtggtgtccgggttatggaaatcgctgtaattcacggtctgctgcaggccgccctggttatccttctgcacgctgtagctcacctggcggctgtcgccccacgggatactgatggtggcgtagacctgattctggctgcccccgccggtgtactggttacgggcaaacgacaccgaggccgagagcccctgaagctcgccgagactgaacactttgttgaagctgagcatgtagttattgttggactgcgcattccagtaattgagccggcttaccgagagggccgcgctcatgttgagtaccggaacggactggctataagtcacggtgtagctctgtttttcatgccatgcatcgccgccgtcggtggcccgacgctgcaggtactccggcatggacagaaaatggcggtccgagaagcggtatccgacgaacgccagggtactgccggttttatcaaacgttttggcatagttgatacggtagctgtaaccggactgcttctgcccgtgcggcaaccgcgcatctgagcgggtgacgtccgcagacagagcgcccagcagccccatattctggccgatcccgagcgccgcggactggtagtcgccggtggaggcaatgaggccgccatacagcgacgtgttgttaaatgctccccaggtggcctccccgagcagaaagtcagggctggccgtgctgttgttatgcgtaccgccgtacagcggacgtccggcggccaccttatagcgaacctgtccctggcgtgccataaaggggacgctagccgtgttgacctgccaggtccggacgctgccgtcgctttcccggacgctgacatccaggttgccgctgatattctggctcaggtcgggaagctcaaaaggccccggtgacacccgggtctggtacagaatgcgaccattctggctgacggtgacctgtgcattactgttcgcaatgccgctaattttcggggcatacccctgaagagagggcggcagcatgcgctcatcgctggccaaagtgagcccagcaaagcggaaggagtcaaaaatagcggagctgaggtacgtctgtccgagcgtcagttttgagcgcagtgctggcagggcacggaacagatacgtctgcggcagataaaaatcggactgtgatgcgccctgcccactgtcaaaacggctgtactggtaatcgctccgcaaccgccaggcgccgagattaaacccggcggtgccgtagaggctgtagctggtagaggtttccccctgctgcggcatatagcggttgaccatcaggctgtaatcaagcaggccagcggtgacgccgtcgctccagcgtgaagggggcacccagtccgggtcctgataacgcatccaggcctggggaataatgaaggtcagacgctgattttcagcgctgtaccgtacctgactgtcagcggagcgcagctcaaggcattgcccgtccgggataccggtaacgggtttcaggccatgaataatcttatccttaagacccagcatggccaccatgtctgttgtcacacagatgacgaccgcatcgcgtccggcaaccggtacaaccctgactggatactgttcccgtaccggctggtcattgagccagatatcgagaatatagttaccgggcgccacatacccctcgcggctgaaggccgtgaggtccacgttagacaggttcccgctgtccagcaggctggcattgaactccgtggcctgcgacttcaggacggaaaatgtcagggtaatcagaatggcaagccgggtaattttcatggcatggcgctttcgtgttgtcgtccgtgtaacagacagcccgcaggcatggtcagatataaaagccgtccgaacccctccgtggacggcttctccctgtcgttatttaccgcgtaaaatcacaggtatttcagagtgtaggtgacagatgcggtgaagtcaccgggcgtgacgccattatccagtgctattagccgggcatagaagttgagttcgttgtttccggcctgcagttgctgagcgtcgtcctccggcatctgggtgttgggctcgataattgcggtgttgtcactcttcagtagctggacaccaacatgctgtgcgctgccgctggtggtgtaagcctttttcgcgacattggctccgccagagaaagagacggtcactttggacattttccctgcggagccagctgtgtccgggatattcggatcgaaagcacagttctgcagatgaatggtgaacggttttgagtccgtggttgcatcggcggtattcagtttacggtaagaaatctgtccaaatggaacggtgatcgcatcgtcgcccggtgcgatatcacagggggagttggtgatggtaccagtaaaggtaattttacctgagccgaacgggcctgctgttggtggatcgactgcatatacagaagcgccatacatcataccggcagccgccatggcaagtattattttattacgcatagataatatgtcctttgggtgaatgagaattattttgcaaaggctgaaaacaaatctgagggtattaatgaaagcgttcagaaaagattcgcatgaataataaacgccgggtgttaaacgaagcacctgaactttccatcgaaaaatattgatttcagctaatgcctaatcagttgtaagaaaattcttattcaaattaaaacaataaaaatagatcgatacgatcgatgattatgatcgtaatttaagaataatcatcaaagaaatacttttaaatgtaattataagcgaatgaacacctaacagacagatattctcagcggacatgaaatattttgtaatatgttatcgggaatgtatgttttgcttttccattacaatggatatttacaacacataatactaatcatatataacaatgaaattacttgtagcataaaaaactagatatagcgcaagtagaagggatttaattccaaagaattaacttaataaatcattatgaaccatcataagcggaagggataaaaaataataaatgaaatgatattcttctgtatttgtgatggacatcacaatagatataaatgcaggtaccctgatattcctgaacttcacggatgaattttaaaaacaatgccgacagcaaagaacaaactggtaatggctgtcagacataatgctgcctgctgtaatatatacagcaggctgggggatattaatgcgcggcgtcgtgctgcacggggtgcgtgggtgattcctgaactgactgagagtctacaactatgccatcctgagctgatttcagtaacagacctgcctgatagtattttccttcgttcatcaaggaaagcgctgtagtcacatccttacgggtttgctgaagaggaatgagttcctgattttcaataacactgacgcctgctagtttcagggcctctatagtcccttttttatctccttctttcattttctggtttgctttattaatagcatcatttttctggcccgcagggagataatcttcggctaccgtaatcgatgaatttatccgaatatagtggtctccttcaactggggcttttttatctgatttgacatacagattccagtcagtgctgtcatcgttcaggagtttttctgcttgcgcagccagttgttccgccttttgggtgcgaccattaaacaactcgaatcgcgacattccgatatcacgcatggcctgccaggcctgtccggatatcttgtcattattcagagtaacgttatcagtcatgtttgttgcggccataagatttcctgaaaacaggataaccatcagcgcaacgcctggcataatatggcttttcataatccatcatctccacaaagtaacattttttatcggattatcctattcagaaccggtaacccacgccaagattaaaaccattgctattaaggcttccgctgttatgggtagcatcaaaatccgctccctcataacccagagttatagcgacattactgaccggggtataagccacgccagcagaataaccatatccgaccttactatcagactcatttatcccgtgatcacgctgatgcaataatacggggcccacttgactatacagacttaactggttatttattttccatgaggggcctgcaagcagggagtaataacgggttgttacacgaccattactgctttcatcggaatagcgctggcttccatttagccaggcaaatgaggttgtcagcccccagtccggtgacatttcatagttgtttgccagccgaaccccacgcaacgtcccggcgtgattagtatgggactgggcgtatccaagtgaaaatgtactggcattatcgtctgcccataccggactggctgcagcagacagcagaacaataccggcacttccggctaatagcattttgttcatcttcttctctccggttatttttacctgatgccttactggcatgtattaagttaaaatctttccgtgataacaaactataaataaatcttttaaattatgagcactgttacgccagcaaatacctttatctccggctatcgggaggctattcacgaaaatatatccaggccagaaacagtatttaataataaataaactgaaaaataaaaactgacaaaaatagaagttcactgatatataccaaaaataatttgagttgctgaaaggcggcaagggagtgagtcccaaggagcatagataacgatgtgactggggtgagcgacaaatctgccgggagcagatttgaacgtcgcgtgcgacggcccgtcagggcgaggcctatggatgggccgagtaatccgtagccaacacataaacaacttgaagtatgaagggtatataacgggaaagaagccatatcggcctggtaaatcaacgtctgtgatttaagttgcaggaaacggctatggagaggggatgcggcagttatcgggcagtaacggcattgttcagtgagtatccaggaaacaaaaaaagaagggagcggtactcccttcgtaaccatgtcagaatacgacattttggtactcttttatttattatctggccgtaaaagttatgctgttggcagatatctccagtcaacataaaaaaataccaccagctaaaaatgtgatgcaaaccaccattaagcaggtaaccaaattgactgtgccactacaatccggaaaagagtttgaatccggggataacatctgatgcagaaattagcaccagtcttcgattcggatacccggaatgcgttcaaactcgcggagattgtttgtgacgacgaccagtccgcggctacgggcatggccagcaatcatctggtcataagacccgacaggtgttcccttgcgggccagttcggtacggatttgaccggtatgtatcgctgcctgtgtatcgtaatccagaacctcaaggcgggagataaatccctccacgactgcaaaattacgctccggtgccaggcttttttcagcaccgtaaatcagctccattaaggtgatggagctgatacacattcgggatgtattgaggttgaagcgttctctgatgtgttcgggcttatttttgatggtgaaaatacaagtattggtatcaagcatgaatttcagcatcagaatccttcccgttcctgtactgcgggttgttctctggtgctcataaaatcagtactggcgccttcgccatcgaaccagctgtcccaggattctccgactggagtaatgattctgcttctaccaaccgcaatgatttcgacatgtttcacatcctccggaaaggatatcgatttaggcaatctgactgcctgggtccggttactaaaaaaaagtgttgtgtgcataactgccccctttctggatatacaacgcgtatatccattatgagtagaggcgatgtatatgtcaaagagatatacaggaaaaaataatccagtcacatgacgcgcactccgcagggcatccttgtccgactccggcatttctgaatacatccaatgaaggaaataccatgcaaacaatgcataaaaaacatatgtgcccatggcttctgcccggtttgctcggtctggctcggtgtgcgccagtaccgcatacttacgcagccatcattgaggcaggattttatccggaaggtacagatctccagcttgttcttaagataattgagaccgcgcgacaggaaatccgtctgatggactattccttcacctcttgggaggtggtccggttcgaacattcagtgagtacaaaattctccatgtcaaagtgatcgtcagcgacgaccgccacaccgaggtggacgcgtcagaatcgctgatcggacacgtcgcaatctacactctgacttataagccagcctgaaggggcatgttggctttgacgatcaggcaaaaaacaacggcgaataaagtcgtatgatgatcttcacatttatcatcatcagcgttcatattactcaacctgtaatcaacctctggcgtttttctgtatccatcacaaccatttccggtaaaggtaaaaaagggatttgaacctttccggagatgataatgaaggtaaatgcatggacaattttgcttatgtcggcgcatctgacggcctgtgccgtccctggcacagaaaaatatcagaccagcatggacagcgttacggcagaaaaaataagccggattatccagtcggatgtcattccttataaaggcgaaaaccatggagaagttatcagccgcgtatcgtctgcttttctcggaacaccttatcaggcggatacgctcatcggtgggcccggcatccccgaagtccttgtagcgaatttcaacggcgtggactgctttaccctggctgattacgttgaagccctggcccgcagcgataatcagaaatcgtttctgcataatcttgccaggactcgctacgccgcgggcaaagttgcttatctcagccgccggcacttcttctctgactggttcgccgcagcaccgcgtaatgcacgggatgtaacgccggatatcagccctgattatgtcgttgttgacaagcagcttaaccataaacctgatggcggcgagtacattcctggtctgggcatccatcctcgtaaaataaattacattcccggaagagccatcaaccagcaggtcatgaaccacctaaaaaacggggattatatcggtgtctactccccgcttgacgggctggacgtttcacatgtgggtatcgtagttcgccatgatgaacaggtgtggttcaggaacgcctcctcattggccgcaaacagaaaagtggtggacacaccgtttatggaatacatgcattccagactgggcatcgttgtgctgcgggctgaatgataaagtcattaccggagtcgccagctgataatagccgtccgacataggtattgaaaccctgtgtactgtggggccgacacggaaaattgctgtaaattcgtggatttagtaaatactagaagatatttgtctggagcgggcgaagggaatcgaggtatcgaagataatcagccgctaaccatttgcttcctaaaggatgatgaatccttgtggttacagttatggttacacattaatttatctctggtcaagtcctctcgtgactctggtcaagtcctctcgtgactctggaacgagtaaccgaagtcctaactttaagacagtggccccaatcgtccagacttgaaaggggccaaggggggagaggcaccgacctttgtctattagatacctacagagatttttgtgagattttttaatacaaggtcataacctaccgccaccagcccccaccgaccgcaaagtgaagacctgtaagcaccagagcaatagctattgcgggcatactgctgattgttattatctatcactccctgtagagcatctggcagaccaagtggacacagaggacgagctcaaacaactcctgtaagctcatggatgtactccttatgttcactcagggtttatagttactctggggtagtaaaccgaataacatgtatcaacgggaaagaggcgtctttctcaacgtcaaactcacctgctttcaccttaacggaaccagtagccaacacatcgaccacactgattaactcaaggtcatacccagcagtgttactatttcgggtcactttgacatctaccgtcttagcgtctttagttgacctgaaagagatagaagcgaaccgcttaggcaggagatagacacctgtatcatcgcccgcatagctgcatacagtgcagcccaatagctcactaatatcctcatgacctgcgcgttgagcggctcggtccaagattgcctcaagtctctcagggaccaatacagcgtaatcgctcagtgtatttcccaactcgaccggaagattcaacgctaatgtatccagaagatcttcagcttgatcagacggtttaccacttagtggggctgcctcaatgatttgaaggtctggcgtatctttcaggacatcgaccacagcggcgaacatctggcggctgtattgaacctgcatatcacctacagtctggattaatgccccctcggtccaaccgcccatcatatcgaagtcagatacatgagtagcagcagaacacaggatgcccgtcttattggtctcagggttcaacactggggtgacagttacgcttgcccctttgatggctgtggtagacggagcatccttagctggattaaacgcgccattatgcttaaagcggacggtgcgattctggagagcctgacggcgaataggcgtagggtcagtgccgtatgggcgaaactcacaagggaagacattctccattacagcagtgcggaagtctccatcattgaaggtctcatccaaagagtcctccagcgcctgaacaaaatcatgtgaatcattcccgaaggccatcggacggcctgagcggtccgtaaagcctacgttgagaacttgggcgtcttgaccattggtcatctgaacatagtcagtgcgtgagatgtcagtgccccatatagaccccttaatgatttgaccgtctttatctcgctgaggctgacgcagagaagccagtgaggatgctttgttaatttgatttgtaatagacacgatgaatatctccttattgtatgaatgcactacgtaaaaagtaactggtgacaccattggtcttatctcagaatccaagcagcgccaccgaaagttatcagttacagcccgaaagcggcccctttattgccgaagcgtttaatcaatgcttcctctcgggctttacgttcagcgaccgccttagcaatctcttctggtgtcgcatgaatagcagccatacgttcttgatgtgccttagcttctttacgtcggcgttcagcctcttggcgctcctgtgcgttgctttgagcccaccagcgggaatacttgccgtaatcacctgcatcaagaccagcggcgtgaatatcgttaagaatacgatttgagttcgccatgtcagagcctgtactgttcagcatggttgtaacgacaatttcggtgaaatacttagtggatagctcctgaccgaataccagtacagtttctttgtcagcgctcagtgcgatatccagtttgcgataagaaatagacatgtttgtttctcctttgaaaagatgttttaaaaggattaaactcatcggtcttccataggtattcctacggcgtctccccgtatcttggtcagttcaaaaggtggtgctagctgtgctagtgggttaattacatgaaatctcttggggtcagccctgcgtcaaccgccatgagacagagggcagctttagagtaatacgggcggttttccttggcaggcagacccagagtagctatcagtgccttggggggtaccaccatcaggcgtaacgccttacggccttctggtgtccttgggtcaatcttgattgtgtcatttgtgttattagtcatgaattacctcccctccagctttgctactgcctgtatgtgttgctgtttagcagcgtcgcttccatgaaccgctatgacctttctgtgcatcttgagtacgttttcaggtcggctgaagaactccagccccttagcgttaaaccgaatgtttataccgtttgggttgaatcgatggtcagtaggtttgataattcgaaagtactccacatagtttggattgactgaccactcgccactgcttgaatgtactcggaacagcttgcgctctttcttaaggatggtcatcagtttctgagcgggtagaccattggccttgcagtaatcgccccaagtcacgcctcgacgattagctgactgaatggctgctcgtttcttctggtcttccagttgaagaactcgacgttctaacgtctgaatatggtcgtaacacttggcgcgtaggtgaacagaatagccagcgaccagaataaaagtatgcttacggtcgagacggtacagaggctgctgtttcccctgcgcatttagatagacatcttcaatcacccctataggactgctcagttttgagcagtgctcagttttgagtgcgttaagctcctcaaccatattgcgaatatcacgaaggacatttcggtgctccttgcctgtcagctcagcaatttcaactgaggtcatggacacaagctggtcgaggttaatgatgctgatttcttgttgagacatagcttgatttcctttttgtttgcaccctgaagtcgcacccccactgacctactcaaagtccccaagcgaagggagaccagcaggacaacaggatgcaaacagaatgactttgagattgaatgaatgaatgacgatgattgtgtcgtagctgtgcggagctactgtatggtgaagcgcgagaggtggaactttgagagacacgtggtgagtggttcggagtgtgtctcctattagtaagtcgtattgattcgtattgattcgtattgatttactactgggagggtctctcaagggtctctgagccacgctaggcatcaggccatacgaaactacatggcatcctaaagaatggagtacaggaccatacagggccatacagttagcttctggggtaatgccttgaggagacctataggtttggtgattgattgttataaatatcatcacctcttaaggtattcccttagagttaatctttaattgtgtctttaagtaaactataagttaatactataagttaatctttaattgtgtctttaagttaactttaagttaagcccctgtagggtagagaccatatttaatatgatgtctattgctattcacttatcgactgacccagagcacacaggaagcattcactttaagtagaacgcttggtgtctgtaattggtcatcccgcccctgaaaggatgcgataagttacggttagagttagagttagagctacctgtagtagtagtagcaagtgtcccagaagagagagaaagagagaaaactttttgtgtcccttctccctatagtgagtcgtattagaaatccttgacaagtagtgaaaactgtgagtcaaaaacatgaccacacaggcctgtagcaatatggtcatcgactatggtcagcctcaaggcaaatctccccggggggggacagcttggttaccccacaatctccttataaacatcagccatcacattgaccagcctatcaacctcaacctctttagcataacggtcgtaagtaatagaccctgaactatgccccatgatcgcctgtgcatacgccaactcgaccccatgttgttttaactgggtcgcaactgtatgtctaaacgagtgaaacgctaagccgctacgatctgcgaggactttaggcaacaacgtccgattaaaccatttactcacctgctcaccgtaaccgttcttcatgaggcgaagaccatcgaacaccatagcgtcatcaccatcagcgcctctacgggtctcaaccaacctcataaagtcagccaatataaaaccataggccccatcgaccagaggcacacagcggtcactatgagcgttcttgatgctcttaccgggtagactactatcgtcttcattgatatgaatataaacggttcccgcctcagtggtcctgacgtctttgacctgtagttgggctatttcattgagtctcgccccagtgatagcagccaaggcggtaacataataatgatacggcttaccagaaggtctctgtgagtaaacttgggcggcagccagtagttgtcctacctgctccgtagagaaagcattacgcgcctcagaggctttacgctggggaaccttaagctctagcccttctgtcatattctttttaatcaggtcattacgcacggcccacttgaaaacagccgccatcttaatgagatatttattattgatggtaacaatatccagacaatcggttttatcctcacgacctagcaggtcaaccaacggaacatctttgaaacgctgcttacgattcttcggcaattgctggaggatatcccgaaccctaagcatatccgcacgagctaacacattggcgtcagcattgaggcccagataatcaaaaacctcgattaacgcagcatgagaagctttgttttctcgtaatgttgctggcttccagttctgggcgttttcctgctcgtactgctcaaagagagaagcaacggttacgcagtgtttgccttcagtaatgcttgttttttggggagcactaacagatagagttgcagaggcttggtcattagcaccagcagcagcatcaaatccatctatataatctataagtggctggctatctcccgcttcaatgcgcttcatgcaggccttgagtacattaagagcctcattaatatagcgatgctggtcaatagtcagtggctcgctatggacaagattctctcccacttccccatactggtcacggtatagatctctcatatctggctcgaagaggtctgaacgacctgtagacaactcccactctgcgatgtccctcaggtgttccctcatttcctcataggaggcgttgggtctgtctgcatggattgccctaagtgctgccttgatatgccgtgagtaagccatagctgtacgtctatccttagtccgtagtgatactgacgctattttataacggctatgggaaggatgtgaaacggtcaggcgatctgtggacttcatcctgaggcggatataaaagacgccattgcgctgataaagataggtttttgagttgagcatgtactgagatcttaagtctgctcactatttcaacaaatttagttacagtgttggttacagtgagtaaaactagcggaaggcttaaagccgtatcccttaggattcagtaggttggagtactttaagaaaggtcatggagcgggcgaagggaatcgaaccctcgtatagagcttgggaagctctcgttctaccattgaactacgcccgctttgagatgcgtaaggcattataaaccttacgctctggttggcaagagacttactggctgactggcgattaattcgccgtcagcacttcggtttactcccctgcggcggcagataacgcagcggatcgatggccgtcgcccggtagcgaatctggaagtgtagtcttacggatgcggcatccgtgctgcccatcgtagcgattttttgccccgctttaacgctttgtccattattaaccagcatggtgtcattatgagcgtaagccgtaatgtaatcttcattgtgcttaatcatgatgagattgccgtaaccgcgcagctggttcccgacatagacaactttacccgctcccgccgcataaacaggcgttccgcgcgcgcccgcaatatcgatccccttatttccgccctccgcggtggaataaggtaaaatcactttaccgttagcaggccatacccaacaacgctgccccaccggcggccaggaggattttggcaccgaagatgacggtctgaccgcagcagtttttgttgctgttttattgctggttttgcgtgttgaactgctactctttgcgctgccgcgcactttaattcgctgccccacctcaatagtataaggcggagaaatgccattcagtcgggccagttctttcacgctggttcccgtagcgcgcgatatacgatacaacgtatcgccgcgcttaacggtatagacggagccggaatacgttcctgagccggaattactggaacaccccgccagcagcagccctgtgcataacagcaccgcaatacccaggctatttttgttcaggcgtcctgcgctcaaaaccattcctcactctattgacagacgccttatgatagcagccaaatgccgtatgcccaatccattgacgccggaaagggtccgtgtggatgatgatgccgcgaatatccgatatgccagcataatatcgaatcacggcacaatagcgctcgtctgcgttctgtcagggcctgttttggtaatgcctttctttctgttatgcgctacgctgatcgtctgagtatatggcctggccatgctgccgggtcattttaattttcaggagctttcatgactgaggaacatgtcgttttattggatgagcaggataagccttccggcacactggaaaagtatgcggctcatacgcttaatacgcctttgcatctggctttctcctgctggctatttaacgaagatggccaattgctggtaacacgacggtcgctgagcaagaaagcctggccaggcgtgtggacgaattcggtttgcggtcatccgcaacaaggcgaaaccaccgaagaggcgatcatccgccgttgtcggttcgaactcggcgtggaaattaccgatctcacccccgtctatccgcacttcagctatcgggcgacagatccaaacggtattgtggaaaatgaagtctgtccggtatttgccgcgcgggcaaccagtgtgttacaggttaacagcgaagaggtgatggactatcagtggagcgaatttaaaagcgtatggcaaagccttctcgctacgccgtgggcatttagcccgtggatggtcatgcaagcgtcagacgaacaagcgcgtaaacgactgctcaattactgccagcgttaaagattgcctgatggcgctacgtctgaacgaagagatgccggatggcggctaatgccccatccggcaatttacatcttatttcaccggacgcatcgccgggaacagaataacgtcgcgaatcgtgtggctgttagtaaacagcatcaccatacggtcgataccaattcccagacccgctgtcggcggtaaaccgtgttccagcgccgtcacgtagtcttcgtcgtagaacatggcttcgtcgtcgcccgccgcttttgcattaacctgatccaggaaacgctgcgcctggtcttccgcatcgttcaactcgctaaagccattgccgatttcacgaccgccgataaagaactcgaagcggtcagtgatttccgggttcacatcattacgacgcgccagcggagacacttcagccggatattcggtgatgaaggtcggctgaatcagatgcgcttcagcgacttcgtcaaagatctcggtgacgatacggcccagaccccagctcttctcgacgtgaatgccgatgctttcagcaatcgccttcgcggagtcgaagttgtccagatcagccatatccgtttccggacgatatttcttgatcgcttcatgcatggtcagtttttcgaacggcttaccgaagtcaaacacttcatcaccgtatggaacctgggtggtgcccagaacatcctgcgccagcgtacggaacagagactcagtcagctcgatcaggtctttgtagtccgcatacgccatatagagttccatcatggtgaactcaggattatggcgcacggagatgccttcgttacggaagttacggttaatttcgaatacgcgttcgaagccgccaaccaccagacgcttcaggtacagttctggcgcgatacgcaggtacatgtccagatccagcgcgttgtgatgggtgataaacggacgggcagacgcgccgcctgggatcacctgcatcatcggcgtttcgacttccataaagccgcgagcaaccataaactggcgaataccggccaggatcttcgaacgggttttgaaggtattacgggattcatcgttagagatgagatccagataacgctggcgatagcgcgcttcctggtcctgcaggccgtggaatttatccggcaacggacgcagcgctttcgtcagcaggcgcagttcggtgcagtggatagacagctcgccggttttggttttgaacagcttacctttcgcgccgaggatatcgccaagatcccacttcttgaactgctcgttgtaaacgccttccggcagatcatcgcgcgccacatacagctgaatgcggccgcctacgtcttgcagggtaacaaaagaggctttacccataatacggcgagtcatcatacggcccgcgacggacacttcaatattcagcgcttccagttcttcagcttctttcgcgtcaaactctgcgtgcagttggtctgaggtacggtcacgacggaaatcgttcgggaacgggataccctgctcacgcagtgcagccagcttctcgcgacgtgccttcatttcattgttaagatcgactacctcgtcagcgccctgtgcgttttgttcagacatgttgattcctcatagccctgctttcaaacttgcttcgataaattgatccagactaccgtccagtaccgcctgtgtattgcgggtttccaccccagtacgcaggtctttaatgcgggaatcgtccaggacataggaacgaatctggcttccccagccgatatcagacttagtgtcttccatcgcctgtttttcagcgttctttttctgcatctccagttcataaagcttcgctttcatctgcttcatggcctggtctttgtttttgtgctgcgaacggtcgttctggcactgcgtcacgatcccggtgggaatatgggtgatacgcactgcggattccgtacggttaacgtgctgaccgcctgcgccagacgcgcgatagacgtcgatacgcagatccgccgggttaatgtcgatatcgatatcgtcgtccacttccggatacacaaacgcggagctaaacgaggtatgacggcgaccgccggagtcgaacgggcttttacgcaccagacgatgtacgccggtttcagtgcgcagccagccataggcatattcgccggagattttgatagtcgcggacttaatgccggcgacttccccttccgactcttcaatgacttccgtcttgaagccgcgcgcttccgcccaacgcagatacatacgcagcaacatgctggcccagtcctgtgcttcagtaccaccggaaccggcctgaatatcgagatagcaatcggcgctatcgtactcgccggagaacatccggcggaattccaactgcgccagcttctcttccagcgtattcagttccgcgacggcttcgttaaacgtctcttcgtcgtcagcttctaccgctagttccagcagcccggaaacgtcgtccagcccctgagtcatttgatcaagcgtatcgacaatcgcttcgagcgatgaacgttcttttcccagcgcctgcgcgcgctcaggttcgttccagacatccggctgttccagctcggcgtttacttcttccagacgctctttcttagcatcgtagtcaaagataccccctaagaacgttggtgcgttccgtgaggtcctgaatgcggttattcaccgggttaatttcaaacatggtctgatttcttttatttgacttgtcaaaatgcggttataagggtgaaatattagcggatttcgccccttaattacagcgaaagtgttgttaaatcgccccgatcatagcggccaaatatcatcgataataatctgtaaactacggttgccgcgaaactcgttaatgtccagtttataagccagttctacctcccgcacgccgttatccggccaacaggtcgtatcaatattaaatgcgatgccatccaacagcgggccgccgccgacaggctccaccatcaccttgaggtggcgctcgcccaccagacgctgttgtagcagacggaaacgaccatcgaataacggttccgggaacatttgcccccacggtccggcatcccgcaacagttgcgccacttccatagacatctccgccgcgcttaatggaccatcggagatcacctcgccttgcaacagggcaggatcgagccattccgtcaccagctcgccaaaacgttgctgaaactgctcgaatttatgctcttccagcgacaatcccgccgccatcgcatgaccgccgaacttgatcatcagatcagggtaaagcgtatccagcctttccagcgcatcgcgcatatgcaacccctgaatcgaacggcctgagccttttagcgtgccgtcgcccgcaggtgcaaaggcgatcaccgggcggtgaaaacgctctttaatgcgcgacgccagaattccgaccacgccctgatgccattcaggatgatacatcgccagaccgcccggaagcgtttcactactgcgctcaagcttttcgcacaggataagcgcttccgcctgcatcccctgctctatttctttgcgcgtctggttaagcgcatccagctcgctggccagaacacgcgcttcgccgaggttgtcgcacaacagtaacgccacgccaacggacatatcatccagcctgccggcggcattcagacgaggccccaacgcgaagcctaaatcactggcggcaagctgctgcggatcgcgattcgatatctccagcaacgctttaattcccggacggcatttcccggcacgaatacgacttagcccttgccaggtcagaatacggttgttggcgtccagcggcacaacgtctgctaccgttcccaacgccactaaatccagcagctccgccagattcggcggcgcgatgccgcgctcgtcgaaccatcctttgtcgcgcaaaaatgttcgcaacgccagcatcaggtaaaacgccacgccgacgcccgccagcgacttagacgggaattcgcagtcgcgcagattgggattaataatcgcttcggcatccggcaacgtgtcgccaggcaggtggtgatcggtcacgatcaccggaatcctcaacgtctttgcatgcgctacgccagcgtgggatgaaatgccgttgtctacggtgacgataagctgtgcgccgcgcgccttcgcctgatcgaccacttccgggcttaaaccgtagccgtcctcaaagcgattaggcaccagataactgatgttgtcacatcccaacgcacgcattcccaatacgcttagcgcagtactggtcgcgccgtcggcgtcaaaatcgccaacaacaataatgcgggtaccttcgcgaaaggcgttgtagaggatctccaccgcgttatctatgccgctaagctgttgccagggcagcattcctttcacgctgcgctccagttcgcgggcgctacgaacgccccggctggcatatagacgtcgtagtaatggaggaagatcggcggggagttccgccgtctcatcagcctcgcgccgacgaagttgtctctgttgtttcacgcgtattatttaccactggtctgtttttgatgctcatcaagaaacgctttcatctctttcggtccctgatagccaggcaccacatagccgttactcaatacaatggctggcgtaccgctaacgcccaactgcacgcccaacgcataatgatcagcaatgttcacgtcacagcttgccggtttcacgcccttacctgccatggcgtcatcaaacgctttgtttttgtctttggcgcaccagatagatttcatatcctgctccgcctggctttccagcccctggcgcggaaaagccagataacgtaccgtgatccccagcgcgttataatctttcatctcttcatgtagcttatgacaatagccgcaggtgatatcggtaaaaacagtaatgacatgtttctcatccggcgctttatagacgatcatctctttttccagcgcatttagctggctcatcagcagtttgttcgtcacatttaccggatgcgcgccgctcacgtcatacatcggcccttgaataatatgtttgccgtcgtcagtgacgtacagtacgccgctgtgagtgaggacggttttcatccctgccactggcgaggcctgaatttccgtactctgaacgcccagcttagccagcgactgacggatagccgcatcatccgcatgggccacgcctgaaaacgccgccgccagtaaagtgaacatcataaaacgctttttcataaactatcctttcctgtcagcactcatgcccgcggatggtgctgttgatgaagttgacgcaaacgctccgttgcgacatgcgtataaatttgtgtcgtcgaaagatcgctatgcccaagtagcatttgtacaacgcgcaagtcggcgccgtgattcagcaaatgcgtggcgaaagcgtgacgtaaaacatgcggcgatagtttttcgctatcaattccagccagtaccgcataatgtttaatacggtgccagaaggtctgtcgcgtcatctgctgcgcacgctgactggggaataatacgtcaatcgatacgccattgagtaaccagggacgcccatgctccagatacgtttccagccaatataccgcctcttcgcctaacggcaccaaccgctctttattgcctttaccgataacccgcaccacgccctgccgcagactgatatcgctcattgtcagccccaccagttccgacacgcgcaaaccggtggcatacagcacttccaacatagctttatcgcgcaactccaaaggttgatcaataagcggcgcctgcaagagccgttcaacctgcgcctcgctaaggtctttcggtaaacgctgcggaagcttaggcgaggccaactgtgcgctcggatcatcctcacgatacttttcacggtacagatgctggaaaaagcgccgcatagcgcttaacaggcgtgcggagctggtcgctttgtatccgccctccacccgttcagccaatagcgtttgtaaatcatcagcctgcgccgtcgcaagcgtttttccgcgatgatgcaaccacgcaacgaccatcgataaatcgcgacgatacgcgcttaatgtattttccgccagatttcgttccagccacagggcatccagaaactgctcaatacgcgctaaatcctgttccattcgcgctccctacttcacgcttacttttggtgcattatgcctcattgtgccgtgaatgcagcgattctgttacactacccgcaacgctatagcagaatcgagatgtaacgtaatgaacatgggtcttttttacggttccagcacgtgctacaccgagatggccgcagagaaaattcgcgatatcctcggcccggagctggtgacattacataacctcaaggatgacgcccccgccttaatggagcagtacgacgtgctcattttaggcatccccacctgggattttggcgaaattcaggaggactgggaagccgtctgggagcaactggacgatctcaatctggaaggcaaaatcgttgcgctttacggtatgggcgaccaactcggctacggcgagtggttcctggatgcgctgggtatgttgcatgacaaacttgccctcaaaggcgttaaatttgtcggctactggcccacagaaggctacgaatttaccagcaataaaccggtcattgcggatgggcaactgtttgtcggcctggcgctggatgaaacgaaccagtacgatctcagcgatgagcgtatacagacctggtgtgaacaaattctcggcgaaatggccgaacactacgcctgaagccttactcgctgtatttccctctcgacggaaccgcgtttgcgtcgttccgtcagtgttggcgctatatcggctgctgtaacagtatccgacgcaactcacgccattccgcttcttccatgctatccgccgccagccataaatgctgatgacgtccagactctgcgcgtaaacgcaacaccatcccgctcttcagtaaccagggaggacgcaagagcgtccagtcctgtccctgccagcgtaagcgcccgtccatgagtagcttgatctctccctggcaggtattaatcctgcgctggctacgtacacagtcaaacacgaccagcgacagtagtatcatccataacggggtataactcagcggccagggcatcaataaaatcaccgcggcaaccagcccatgaaggagcaatgagatccactgagcgcgccatgagacgcgtaaatcagattgccacaggaccacgttcccgattccgtgtctgaatgagtcggaccatctgttccagttcagcgtcagccggtttaccgtgattcattaaccagttaaataaatccgggtcatcactctgcaacaaacggacaaaaatacgcttttcttcatcacttaaactatcgtactcatgttcaaaaaacggcatgatggaaatatcaagttcgcgcataccgcgacgacatgcccagtgaatacgtgctttattgtgaatatccatgttcttcctgcctcgcgaaaatgaagtaccgggctattgtaacgtgtttttggcgttgttttacgggaatctcagtaatctggaacgcgatcgcgaaatagaaggctgggaatcaatatgttcatccgttttggataccacctcgcaaaacgatcaatccgctttcaatgggctatttaaagcacttgcaatgaccgatggctcttttaccattaaccattattgttgcagctaaccaggacattatttatggcttttatctcctttccaccacgtcatccctcatcgtcagcccgcctgccgctgacgctgatcgcgcttgacgactgggcgctgtcgtccattaccggcgtagacagtgaaaagtatattcagggccaggtcaccgctgacgtaagccagatgactgaacagcaacaccttctcgccgcccactgcgatgctaaaggtaagatgtggagcactctgcgactgttccgtgagcgcgacggtttcgcctggattgaacgccgtagcgtgcgtgaagcgcaattaacggagctgaaaaagtacgccgtattttccaaagtagtcatcgcgccggatgacgaacgcgtattgcttggcgtggccggttttcaggcccgcgcggcgctggctaatgtctttagcgaactgcccaatagtgaaaatcaggtggtcagagacggcgcctccacgctgctatggtttgaacatcctgcggaacgattcctgcttgtcaccgatgtcgcgacggccaacatgttaacggagaagttgcatggcgaagccgaactgaataacagtcaacagtggctggcgttggatattgaagcaggcattccggtgattgacgcggcgaacagcggtcagtttatcccccaggcgactaacctacaggcgctgggcggcatcagcttcaagaaaggctgctacaccggacaggagatggtcgcacgggcaaaattccgcggcgccaataaacgcgcgctttggttgctggcgggcaaagccagccgggtaccggaagcaggagaagatctggagctacagatgggcgagaactggcgtcgtaccggcgctattctggcggcgacacagttggacgatggtcagttactggttcaggccgtcatgaataacgatttagaagccgaaagcgtcttccgcgttcgcgacgatgccaacaccctgcatatcgtcccgctgccttactcgttggaagagtgatatcacgttaaaagtcggatagcctgatagcgcaacgccatcaggctcgcacgtgctgctctcgtaggccggataaggtacgacagcgccgccatccggcacgggcatccgggaattacgcctgtcccacatacaaatagatggccaggaagtggcacacgctgccgcccagcacaaagccatgccagatggcgtggttataaggtatgcgtttgcaaacatagaaaattacgcccagcgagtaaacgacgccacctaccgccagcagcgtcacgccgcctatcgccagcttaatcgccaactgataaaccactatcagcgacagccagcccattgccagatacgtaaccagtgaaagcactttaaatcggtgcgcaatcgtcaacttgaagaggataccgaatagcgccaggctccagatcacaatcattagtccgcgcgccagcggcgaatccagacctaccagcagaaatggcgtataggttccggcaatgagcagatagatagcgcagtgatcaaatttctttaaccagatttttgcccgctgatgaggaatggcatgataaagcgttgaggcaagaaaaagcaggatcatgctcccgccatataaactgtagctggcgatagccgtcatacccgcattcgcctctaccgcctgaaccaacaacagcaccaggccgacaataccaaataccaatccaatgccgtggctaatactgttggcgatttcctcagccagcgaatatccctgcgtcattaatggtttttgcaccataacttactccggagaaacgttcataacgatgaactgcacctctagcgtaactgagaatggttccagtgaacacatgttagctaaaataaattcgcaaaattaaattttgtttattattcaacaaattaactacaaaaactcaactaacacgcgttcatatttatcaaaggcatttaaaatcaatcacataaaattgcgtctggttgggatagatttcagcaatgacccgtttcagctcatcaagcgacatattttcctgttgcgcatgtttttcgttcaacgtatccagcgtcacagttgacgttcctgtcacttcgattgtgcaaaaatagccatcatcttcgaaccgccccacgcgtagagcatcgcctgctttaaagtgggactcggaggcatcacgaatagtgatggttttacgccctgccagaatgtcattctggaaacgttgaaagaaagtaatgtcatttggctgcatgtggttatccccctgaatatggccccttgaagtggatgttacgatctgaatgtgttcttgccccgacacgcgagcatcctggaattttgcgtacgctttacatgccacttggtgcagaatgaatgataacagactaaataaattgagattatgcaacaatgagaaaactcaccctgccaaaagattttttatggggcggcgcggttgccgcacaccaggttgaaggcggctggaataaagacggtaaaggccccagcatctgcgacgtgctaaccagcggcgcacacggcgtgccacgcgaaatcacccagaatgtcgttgctggcaaatactatccgaaccacgaggcggtggatttttacggacattacaaagaagacatccgtcttttcgccgaaatggggttcaaatgcttccgtacttctattgcctggacgcgtatcttcccgaatggcgacgaatcccagccaaacgaggccggtctgaaattctacgacgacatgtttgatgagttactcaaatacaacatcgaaccggtcatcaccctttctcactttgaaatgccattacatctggtacagcactacggcggctggaccaatcgtaaagtggttgatttctttgtccgttttgctgaagtcgtgtttgaacgctacaaacataaggtcaaatactggatgaccttcaacgaaattaacaaccagcgaaactggcgcgcgccgctgtttggctactgctgttccggcgtggtgtataccgagcatgagaatccagaagaaaccatgtatcaggtcttacatcatcagtttgtcgccagcacgctggcggtaaaagcggcacgtcgtattaatccacagatgaaagttggctgtatgctggcgatggtcgcgctgtatcctttctcctgtaaaccagaagatgtgatgtttgctcaggaatcgatgcgtgaacgctacgtctttaccgatgtgcagctgcgcggctattacccgtcctatgtgttgaacgagtgggagcgccgcggatttaacatcaaaatggaagatggcgatcttgaagtgctgcgcgaaggcacctgcgattatcttggtttcagttattacatgaccaacgcggtcaaagccgaaggcggtagcggcgatgcgatttccggttttgaaggcagcgtaccgaacccctatgttaaagcatctgactggggctggcagattgacccggtgggtctgcgctattcattgtgtgaactgtacgaacgctatcaaaagccgctatttattgtcgaaaacggttttggtgcttacgacaaagtagaagaagatggcagcatcaacgacgactatcgcattgactacctgcgcgcccatattgaagagatgaaaaaagcggtgacttacgatggtgtcgacctgatgggctacacgccgtggggctgcatcgactgcgtgtcgttcaccaccggtcagtacagcaagcgctacggcttaatctacgtgaacaagcacgatgacggtacgggcgatatgtcgcgttcgcgtaagaagagcttcaactggtacaaagaggtgattgccagcaacggcgagaagctttaactcctgcacgttacccgccagtcggcgggtaacactttgaacgagtcttaccaggtcttacctattttaaattcccagcgtacatcttccattttggttggcgacttcgcttcctgcattaccgggaagaaggctccggcaccaaaccataatttcagtgaatcgacggcaatattaaatgacggaccaacaacccattcggtagttccagaatggttattaattacgctgccattagacagttttttcgttccagaggcattattgctgtaggcactttccagaccaagatccagcggtaaatcgctaaacatataccgcacctgggtattccactggaattcgttacctcgtttcacgtcctggttaccgcgctcaaatggtccctgatatacaaaacccatatcccctttaatgttaggagtaaataattttgttaaagtgagtgttactcttcctccccaggcgctattcccaggcaaatgattatctccatcttgcccggtgggtagtaatactgccccacctaccgtaacccaaaacggatcacctcttcgctggctcattaaagcataattgacccccaccgattggtcgctcattccctctatgtgctcaggagacagattgtctcgtttgttattgatataggaacccacagttgataattccagtctgtcggtcaaaccgtaacgaatcttcaataaccatatctgggagtaaacatccggacttccgtgcccctcgatttgatgatctttatcgcgaaatgagctattcacggcggttaataactttccttccggcaatactgaaccaccagaaatagcggtattaactggtgcacctaatagattactgggattattttctccgttagctgccattgcattcattaatagaaaatatgtcattaatggcagaaatataaatcgtttcattattccctccaggtataaaaaacaaagcgctaagttaataaatatttacgttatttatgcttatttttaatttataatttaaattaatagcttgatgaatttaatatacggaaatttttgtaactatattgagaggtaaataacgattccgaagagaaactatttgtaactatatgtaaatatgctgtgttgttttgattaaataacagcaaggtaaaaatgatgcacaatgaatcattaggctctaaaaaaccggtaatttaattctggctaatacactgatacaaacgccaggttgcctgacaggagccaacgatttactgtaatatattgaattagtaacactttgtagcctgaataaggcactcacactgcatccgacataaacaaaacgcactttattaacaagctgaaaaggcgccgaagcgcctttagaaaacagtcgaatcagtaaattactggtagtcgctaatcggtacgcaggagcagaacaggttacggtcgccataaacatcatccagacgtttcaccgtcggccagtatttgtctgccacgcctgccgggaatacggcaacttcacggctgtacggatgcgcccactcggcgaccagttcgctctgaatgtgcggcgcgttcaccagcgggttatcttccagcggccagacaccggctttcacctggtcaatctctgcgcggatagccagcatcgcatcgataaagcgatccagctcagccttaccttcagattccgtcggctctaccatcagcgtgcccgccaccgggaacgacatggttggcgcatggaaaccatagtcgatcagacgcttggcaatatccagctcgctgatgccggtttcttctttcaatgggcgaatatcaagaatacattcgtgcgccactcggccatcgcgaccggtatacagtaccgggtacgcgtctttcagacggctggcaatgtagttagcgttaagaatcgcgacctgacttgcctgcttcaggccttctgcgcccatcatgcggatgtacatccaactaatcggcaaaatggaggcgctgccgaacggcgccgcagacaccgcgccctgacgggtgagcatcccttcaatttgcaccacgctatgacccggtacgaatggcgccagatgcgctttcacgccgatcggtcccatgcctgggccaccgccgccgtgcggaatgcagaaagttttatgcaggttaagatgcgaaacgtccgcgccaataaagcccggtgaggtaatgccgacctgagcgttcatgttcgcgccgtcaaggtaaacctgaccgccgaactggtgcacaacttcacacacttcacggatcgtttcttcatagacgccgtgggtggacggataggtcaccatgatgcaagagaggttcgcagcatgttgttctgctttggcccgcagatcgtccaggtcgatgttgccgttcttatcacacgccacaaccaccacctgcattcctgccatatgtgcagaagcagggttagtgccgtgagcagaggccggaatcaggcagatatcgcgatgcccttcgttgcggcttccgtgataatgacgaatcgccagcagccccgcgtactccccctgcgcgccggagttcggctgcatacagacggcgtcgtacccggtgagtttcaccagccagtcagaaagctggctaatcatctgatgatatccttcggcctgctccggcgggcagaacgggtgcagttcagcgaattccggccaggtgatagggatcatctcggcggcggcgttcagcttcatggtgcaggaacccagcgggatcatcgcctggttcagcgccagatctttacgctccagcgagtgcatatagcgcatcatctcggtttcgctgtggtagcggttaaataccggatgcgtcagaatcgcatcgtcacgcagcataccttgctgaatggaacggctatcaagcgccacgtctttatccagtgtttcaatgttcagaccgtggctgtcgcccagcaaaacattgaacaactgcgccacattctcacgggtggtggtttcatcaagggtaatacccaccgcgttatgaatatcgctgcgcagattgatctctgccgcttccgcacgcgccagtaccgcagctttatcagctacttccacacacagcgtgtcaaagtagtgcgcatgacgcagctttaagcctttctgttgcagaccggccgccagaatatcggtcaggcggtggatacgattcgcaatgcgtttcaggccaaccggtccatgataaacggcatacagactggcgatgttagccagcagtacctgcgaggtacaaatgttggagttcgctttctcacggcggatatgctgctcgcgagtctgcatcgccatgcgcagtgcggtattgcccgccgcatcttttgagacgccgataatacggcctggcatggagcgtttaaattcgtctttggcggcaaagaacgccgcgtgcgggccaccgtaacccatcggtacgccaaaacgttgcgcagagccgaaaacaatatccgcgccctgtttgcccggcgcggtaagcagcaccaacgccataaaatcggcggcgacgctgacaatcaccttacgggctttgagttcgctaatcagcgtgccgtagtcgtgaatttcgcccgtggtgcctacctgttgtaacagcacgccaaatacgtcctgatgatccagcactttgtccgcgtcatcgacaatcacgtcaaagccaaaggttttggcgcgtgtacgtaccacgtccagcgtttgcggatggacgtcagccgccacaaagaaacggttggcatttttcagtttgctgacgcgctttgccatcgccattgcttcggcggcagcggtggcttcgtcaagaagagaagccgaagccatatccagtccggtcagatccagcgtcacctgttggaagttgagcagcgcttccaggcgcccctgagagacttccggctgataaggagtgtaggcggtataccagcctggattttccagcatgttgcgcaggataaccggcggtagctgcacggcggtgtagcccatgccaatgtaggacgtgaagcgcttgttacgcccggcgatggcttttaattccgccagtgcggcatattcggttgccgcctcgccaacctgcggcggagtcgcgagctgaatgtctttcggcacaatctgacctgtcagcgcgtttaacgactcggcgccaaccgcattcagcatctcttgctgctgcgcggcgtccggtccgatgtggcgttcaatgaaagcgccgcggttttcaagctggcttagcgtctgtgtcatgggcgatggttcctgaaacgtgcagtgaatcgtaggtgtctctaactcaattgcccggtggcgctgacgcttaccgggcctacgcgtgcgaaaacgaatacgcaaaatcattcgcgttgcagtgagtaggccggataagcattagcgccatccggcacaacattattcgtcttctaacaatgcctcatacgcggtggcatccagcagcgattcaagctcgctttcatcgctggctttgattttaaagatccagccaccggcatacggttcgctgttcaccagctccggggagtcgctcagcgcatcgtttaccgccacgatctcgccgcttaccggcgcataaatgtcggacgccgcttttacggactccgccacggcgcagtcgtcgcccgcgcttacggtcgcgccgacttccggcagatcaacaaaaaccatatcgcccaacagctcctgagcgtgttcagtaatgccaacggtgtaagtgccatccgcttctttacgcagccattcgtgttctttgctgtatttcagttctgcgggtacgttgctcatcaattaatctccaaaaaaggatgaatcacgcgacggctttgccgttacgcacaaaaacaggtttagtcacttttaccggcatttcacggttacgaatttgtacaatcgccgtctcgccgatgcccgccggaacgcgcgccagcgcaatgctgtagcccaacgttggggaaaacgtcccgctggtgataatgccttcttgctgattgccctgcgcatcggtaaaacgcaccggcagttcattacgcaatacgcctttctcggtcatcaccagaccgacaagctgctcatggcctttttcacgctgcatctccagcgcctcacggccaataaagtcgcggtcagcaggttcccaggcgatagtccatcccatattagccgccagcggagagataccttcatccatctcctgaccgtacaggttcatgcctgcttccagacgcagcgtgtcgcgcgcgccaagaccgcacggcttcacgcccgcctccaccagcgcacgccagaaatccgccgctttttcattcggcatggcgatttcatagcccgcttcgccggtataaccggtggtggcgataaacagatcgcccgcctgaacgccgaagaacggcttcataccttctactgcatggcgctgttggtcagtaaacagagtcgccgctttttcctgcgcattcggcccctgtaccgcaatcagcgacaggtcgtcacgaacggtgatgtcgatggcataaggttcagcgtgttgggtaatccaggagaggtctttttcgcgggtggcggagttaacaacgagacggaagaaatcttcagtgaagtagtagacaatcaggtcatctatcacaccgcccgatgcgttaagcataccggagtagagggctttacccgtcttcgttagcttcgcgacgtcgtttgccagcagataacgtagaaactctcgtgtacggctaccatgaagatcgacaatggtcatatgcgatacatcaaacatcccggcatcggtgcgcacagcgtggtgttcatcaagctgagagccgtaatgcaggggcatcatccagccatgaaaatcgaccatgcgggcgccgcatagcgtgtgttgttcgtacaaaggcgtctgttgggccatcttttcctcgttgaattagcgggggctaacaaccattttcatgggaaatcttcgccacgaaacctggcatcgacgccctttttcctgcgccgacgcaaacgttctcttgctcctgaacttaccaccgaaccaggcgctaaaccataaggctgaatttaccatcacattagcttatgactaaaaaacgctaaaatcccatcagcacaaaaaaccactattacgctaaataacttccataaaaatgaagctgatacgatttatcacaacataaattaatattaaatgcggaaaaaatgtcgaaaatcgcgttctccaaaaatagtggcattagaaaatataatgcgaaataagcggtgaaattagattatttcaaacgaggaaagccccccggcgcgatagccgggaaagcaaagtgtgacgggtttcaaactcttgctggcgtgcagtcagacgcttaacgaagccattgcggaaggtcgtttagccccattgcctggcgaagcagttggggtttgacgccggggagcgtgtccgccagtttcagtccgatgtcgcgcagcaatttttttgccgggttttcgccggcaaacaggtcacgaaaaccttgcatcccggcaagcatcatcgccgcgctatgtttacggctacgctcataacgacggagataaagatgttggccaatgtctttgccctggcgctgaagccggcacagatcgtccaccagttcggccgcgtccataaaaccgaggttgacgccttgccctgccagcggatggatggtgtgcgcggcatcgccgaccaacgccagacgatgcgcggcaaactggcgagcatagcggcccgtcagcggaaaaacctgccgttcgctttccaggcggcataagcccagccgattatcgaaggcgatagtcaacgcctggttaaacgcctcgtcgccgctctgttgcatacgctccgcatcctgcggagaaagcgaccagacaatggaacacagatgcggatcgcttaacggcaaaaacgccagaataccttcaccatgaaacacctggcgagcaaccgcgccgtgcggctcttcggtgcggatagtcgctaccagcgcatggtgacggtagtcccagaaagttaagggaatatccgctttgttacgcagccaggagttggcgccatccgcggcaatcaccagacgcgcggttaacatcgcgccgtcttttaaagtcaggaaggcgtcattctctccccaggcaacctgctgtaactccgctggcgccattaaggtgatatccgccgcttgctgcgctttttgccacagtgcatagtgaatgacgctgttttcaacaatatgccccagatggctatatcccatgcttgcgtcatcaaacgtaatacggccaaagctgtctttatcccagacttccataccgtggtagcaacttgcccgtcgcgccacaatgtttgaccatacgccaagacgggtaagcagtttttcgctggcggcattaatcgccgacacccgaagctgaggcggcgcatcgttcgccaactgctggggaacaacgtgatccagtaccgcaacgcgcaaaccgctcccctgcaagccgcaggcgacagccagtcccaccatgcctccgccaactattgctacatcaacactttgcactatttactcctggaaaccggaacaatcaaaaccgtaggccggataaggcgtttacgccgccatccggcatttttacgaacacgatgccggatggcggcgtaaacgccttatccggcctacagatctgcttaacgcgcaacccaacctaaggttcgctgtgccagcgcatcgcgcgcaggtggtaataattccatcgccattaaaccgatattgcgcccaataaccagcggcgcccaacgatttgcaaacagatggaccagaccgttcgttacgccaatcgtcgtatcccggtcaacctgacgacgctgctgatagcgcgataacacgtgccaggcgccaatatcctcgcccgcgtcctgtgccgcgaccagcgtttccgccaggctcatgacatcgcgcagaccgagattaaacccttgtccggcgataggatgcaacgtctgcgccgcattgccgaccacgacagtccggtgagtaaacactttcgccgccgtagtcagggcaagcggatacgcgctgcgcttacccgcctgagtaattcgccccagccgccagccgaacgcggcctgcaacgcatgacagaactgcgcgtcggaccagctcagcacctcatcgcgctggtcgagcgggtgacaccaaaccagcgaacatcggccatgcgacatcggcaacatcgccagcgggccattgggggtaaaacgttcaaaggcgcgtccctggtgcgggatagcggtcgcgacattcgctatcaccgctaactgttcgtaaggctcctgatgccagtcaacgccgcaggctgatgccagcgcggagtgggtaccgttagccgccaccagcacgctgccagctatcacattgccgttttccagagtgacgttaacctgctgttgggtacgcgacacgctggctacgcgctccgggcagtgcagcgtaacgcctggcgctttacgcaagagcgcaaacagacgcagcccgatatcatgcagctccgcaacgtgacccaacgctgccaggctgtaatcctgcgcgtctagagtcacaaatccggcatgaccgcgatcgctgacgtgtacggtgttgattgccgttgcgcaatcggaaatcgcctgccagacgccaattcgcgccagttgctggcaagtgcccgccgccagcgcaatcgctctggcgtcaaagccgggatgaccgtcggcttcaggcgctttcgcttcaatcaggtgtaccggcaacgtcccatgactgaactgagagatggccagcgccagcgttgcgcctgccatgccgccgccaacgataatgacgctcattgctgccgcgccgccgccattaatgcctcaatgtcatccgccttcttcacaacgccagcggtcaggttttcattaccggtttcggtaatgacaatgtcatcttcaattcgaacgccaatgccgcgatacgcttccggcacgtcggcatccggcgcgatatagaggcctggctctacggtcagcaccatgcccggctccaggatgcgggagcgatccggcccataaacgccgacatcatgaacatccagccccagccagtggctcaagccatgcataaagaaaggacgatgcgcattctcggcaatcagttgatcaacctctccttgcaaaatccccaacttcaccagcccggttatcatgatgcgcactacttcgccggtcacctgctgaatagaggtaccaggacggaacagtcgcaggctggtctccagcgattccagaacgatgtcataaatttcacgctgagctggcgtaaatttcccgttcaccgggaaagtacgcgtgatgtcgcccgcgtaacctttatattcacagcccgcgtcgataagcactaaatcgccgtcgcgcatttcactttcgttttcagtgtaatgcaggatacagccattttcgccgctgccgacaatggtgttataggagggatagcgcgcgccatggcgattaaattcgtggtgaatttcaccctccagctgatactcaaacatccccggacggcatttttccatcgcgcggatatgcgccagagcgctaatttccccggcgcggcgcaggacagcaatctcttccggcgatttgaacaggcgcatctcatggacgatcggtcgccagtcagtcatggtggccggcgcggtcagattctggcgggagcctttacgcagcttctccagcgcagccagaacaatctcgtcggcatacgcatattcgccctgcgcgtggtacaccacatccagaccattaagcaactgaaagagttgctggttgatttcgctaaacgccagcgcccggtcaacgcccagtttttccggcgcggcatcctgtcctaaacggcgaccaaaccagatttccgccgtcaggtcgcgaacgcggttgaacaaaacgctgtggttgtgggtgtcatcactcttaatcagtaccagcacggcttccggttcgttaaaaccggtgaaataccagaagtcgctactctggcgatacggatattcactgtctgcgctgcgcgtcgcctccggcgcggcaaagatcagcgcggcgctgccgggctgcatttgcgccagtaatgcctggcgacggcgttggtattcctgctgagtcatgacatggcctccatttcgttttttcttagtgtagcgtcggtttacgcacttccggcgcggtcggctgttggcgcgtgaaagtgtcatgacataacagcgccgcaacacggacatattcgatgatctcttcgagcgacatctccagctcttcctgatcttcgctctcatcataaccaagctgcgcaatattacgcaggtcgtcaatcgcttcacccgtttcgccggtgactttatcaagtttaggctgcgttacgccgaggccaagcaaaaagtggttaacccacccggctaatgcatctgcgcgatcgaatacgctgacatcgtcgccttcaggcagataaagctgaaaaagaaagccgtcgtcttccagcgcgtcgctggtcgccgcgtgcattttgcgcagcgcctgagcaagctcatgcccgaaggccagaccttcgttcgtcaggtcatgcaacagcggctgccatgagctgtcgttgttgccgccgcaaatcatcccgctgattaaaccatgcatttcagccggggtcagaccggccccttgttgattcaaaaaccggttcatttcgtcgtaaccaggcatttcgttctgtatagacataagcattcgtcatcaaagggaggatattcatgatatgctaccactttggaccctggtgaaccagaaaagggcttgtatcttcacaccagggtagctatagtgtcgccccttcgcggaccctgggtctggagacgaaggcagcgcagtcaatcagcaggaaggtggcatgtctgcacaacccgtcgatatccaaatatttggccgttcactgcgagtgaattgcccgcctgaccaaagggatgcgttgaatcaggctgcggacgatctgaatcagcggttgcaagatctgaaagttcgtactagagtcacaaatactgagcagttggttttcattgccgcattgaatatcagctatgagttaactcaggaaaaagcgaagacccgcgattacgcggcgagcatggaacaacgtattcggatgctacaacagaccatcgaacaggcgttgcttgatcaaggtcgcataaccgaaaaaacgggccaaaactttgaataacacttttcgctttactatggtaaagtgattgtgaaaacagtatttctctgagatgtttgcaagcgggccagtcccctgagccgatatttcataccacaagaatgtggcgctccgcggttggtgagcatgctcggttcgtccgagaagccttaaaactgtgacgacacattcaccttgaaccaagggttcaagggttacagcctgcggcggcatctcggagattccccttctgactggcgacagccatgacgcaacttcccgaactctctttatcacgacaagaaatccgccgaatgattcggcaacgtcgccgtgcgctgacgccagagcagcaacgccgctttggtcaacaggccgccgcccgaatgctcagctttcctcccgtcgtgatggcgcacactgtcgccgtgtttctctcctttgatggcgaactcgacacccagccgctgatagaacagctatggcaagcgggcaagcgcgtctaccttccggttcttcatcccttcagccctggcaacctcctgtttctgcactatcatccgcagagtgcgctggtgaccaaccgcttaaatatccgggagccacggcttgatgtccgcgacgtattgccgctggcaaagctggatgtgctggtaacgccgttagtcgcgtttgacgaaggcgggcagcgtttaggcatgggcggcggtttttatgaccgcacgctacaaaactggcagcagcataagatcctacctgtgggctacgcgcatgattgccagttagtagaaaaactgccggttgaagagtgggatatcccgctgcctgcggtggtgacgccgtccaaaatttgggagtggtagccgtgttttgtcgattgacagcgtcgcttttttgacctaaatttctcggtgaagggtgagggaggcgaacctccctcctgcgtactcactgttaatatgctgggcaagcgatgattaacaggatcagcagcatgatgacgtatctcatcatcgtccctttcctttttagagcccctgcctcggtaggggctttcccgtttcagcgctatgctgagcccttatcgtaaattccttttattgctgtacaacacgcaacgctgcctttaattaccaattgcggcaaggctcgaaaacagaatgtatgcgttacacgaagagatgttgaggcagggaaaccagagaaaggatgggcaggtcatctcctgcccatttagaggaaattagtacagcagacgggcgcgaatggtgcccggaatcgccttcatcgccagcagcgctttctccgccacatcgccatcggcttctatatcaattaccacataccccattcgggcggaggtttgcagatactgtgcggcaatgttaacgccctgctcggcaaagatctggttaagcgcggtcaatacgcccgggcggttttcgtggatgtgcatcaggcgacgaccgccgtgcagcggcagcgacacttccgggaagttcacggcggacagcgtcgagccgttatccgagtacttaatcagttttcctgcgacttccagaccgatgttttcttgcgcctcctgcgtcgagccgccgatatgcggcgtcaggatcacgttatcgaattcgcacagcggagaggtaaacggatcgctattagtggccggttccgtcgggaagacgtcgatagccgcccccgccagatgtttcgtcgccagcgcgtcgcacaaagccgggatatccactaccgtaccgcgcgcggcgttaatcagcagcgaacccggcttcatcagggctatctcttttgcgcccatcatgtttttggtggaggcgttttcaggtacgtgcagactgaccacatcgctcatattcagcaattcagacaggtgctgcacctgagttgcattaccgagcggcagtttattttcaatatcatagaaatagatatgcatccccagcgattccgccagaatgcccaactgcgttccgatatggccgtaaccgataatgccaagctttttaccgcgtgcttcgaacgatcccgccgccagtttattccatacgccgcggtgcgctttggcgttcgcttccggcacgccgcgcagcagcagcaatagctcgccaatcaccagctccgccacggaacgggtattcgagaatggcgcgttaaagaccggaataccgcgttttgccgccgcatttaaatccacctggttggtgccgatgcaaaaacagccaatcgccaccagcttctctgcggcgttaatcacttcttctgtcagatgagtacgggatcgcagaccgatgaagtgggcatcgcggatggacgctttcaactgttcagcgtccagcgcgcccttgtgatattcaatgttggtgtaacctgccgcacgaaggctttccagcgccttttgatgcaccccttcaaccagcagaaatttaattttatctttctccagcgatacctttgccatttccccgatcctgtctttttttgccatctgatgttgtgtgtggatttgcatccgtccttcaacatatcaaaaaaaattatcacggcaatatgaacgtttgcgccaacgccgtgaaggaatcgcatacagcgggaaatagcagatgaaaataccgggaataacttttctttggagggatcggcagggcaaacgattaaacgtgatacatgtcaccaaatttgccctgaccgaattctttacgcggcaggaaatacgcctggcgggatcattttacgatggttttcaccccgtccggcgtgccgatcagtgcgacatcggcgccacggttggcgaacaaccctacggtcacgacgcccggaatcgcgttaatggcgttttccagcgcgatgggatcaaggatttccataccataaacatccagaatcacgttgccgttatccgtgaccacgttctgacggtactccggacgcccgcccagcttcaccagttgacgagcaaccgcgctgcgcgccatcggaatcacttcgaccggcaacgggaatttgccaagaatatccacctgtttagaggcatccgcaatacagataaatttctccgccacggaagcaataattttctcacgggttaatgccgcgccgccgcctttgatcatctgcatatgaccgttgatttcgtccgcgccatcgacatagatacccaggctatccacttcgttgagatcaaacacatgaataccgaggcctttgagtttttcagtcgaggcgtccgagctggagaccgcgccttcaatctggcctttcattgtgcccagcgcatcaataaagtgtgcggccgttgagcctgtaccaacgcccacaatggtgccgggctgtacatactgaagtgccgcccatcctaccgcttttttcagttcatcctgcgtcatagatcgtttcgcctgtggtgtgaaaatacagccgcattatagaacattgtcgggaaaaatctccgtgtccgtacacaggctacggatttcatctgtaccgacggcaaatttatgtcatagtgcggaaaaaataacaggagcatgacacaacaatgaaacgtccggactacagaacactacaggcgctggatgccgttatacgtgaacgaggattcgagcgcgccgcccagaagctgtgcatcacgcaatccgccgtctcacagcgcataaaacagcttgagaatatgttcggacaacctttgttggtgcgtaccgttcctcctcgccccacggagcaagggcaaaaattactggctctgctgcgtcaggttgaactgctggaagaagagtggctgggcgatgaacaaaccggctctacgccgctactgctgtcgctggcggttaacgccgacagtctggcgacctggctgcttccggcgctggcgccagtactggcggactcccctatccgtctcaatttacaggtggaagatgaaacgcgcacgcaagaacgtctgcgtcgcggcgaggtggtgggcgcggtgagtattcagcatcaggcgctgcccagttgcctggtagacaaactgggcgcgctcgactatctgtttgtcgcgtcaaagccgtttgccgagcgctattttcccaatggcgttacccggtcgtcgctgctgaaagcgcccgccgtcgcgttcgaccatctggatgatatgcatcaggcttttttgcaacagaatttcgatctaccgcccggcagcgtgccgtgccatatcgttaattcatccgaagcgtttgtacagcttgcgcgtcagggcacggcctgctgcatgatccctcacctgcagattgagaaagagctggaaagcggcgagttgatcaacttaacgcctggcttgctacaacgccggatgctttactggcaccgctttgccccggaaagccggatgatgcgcaaagtgaccgacgcgctgctggagtacgggcacaaggtgctgcgtcaggattagcctctctatgaatgccggatggcggcgtgaacgtcttatccggcctgcatgacccattattcccccgtcgcttctttgaaattgatcacaaaatcattgcgttcaggcggcaaaaaacgacgcgccattggctattttttgctggcggcaaggcgactcaaaacgctcaccgtattatcaaatcttcatttcattgcgtaatacggagcaaaaaatgagaacaccgggagaaaacgcggcctggaagcgcccaggccgggcgagattactgcgtgctggcggccgttgtcgacgtctgccctgttccaggttcaagctggaataccacatcgacctgatcgtcgaactgaatagtcggctgctcgtaagtttcctgcgcggataccggcgcagcatctgcggctttcatcattcgcaccaccggactcggctgataattagagacatggtaacgaacgctgtaaaccggccccaatttgctgttaaaaccggctgccagcgcttgcgcctgatgaatcgcgtcatcaatggcggctttgcgggccttgtctttataggcgtccggttgcgccacgcccagcgataccgaacgaatctcgttcagacccgccttcagcgcgccgtccagcagcgaattgagtttatctaactgacgcagcgtcacctcaacggttcgcaccgcgcgataccctttcagaatgcttttaccgttttggtaatcataatccggctgcgtgcgcagattcgccgcgctaatgtcttttttcgcaatctgattttgctcaaggaaggaaagatattgcgccacgcgctcatcggcctgcttcttcgccgtcgccgcatccttcgccgcgacgttcacttcaatcgctaaggtggcgatatcaggcacagcatcgacgcttgctgtaccggaagtcacgatgtgcgggccttccggcaattcgcttgcctgcgccgacattgcacttaaacccactaatgccgccagggccatcactttgaacttcacagtctctcctccatattgcagtcattgccctgatatacagggcgcatgcaggcaagcttagcggatatcggtctgttgtccatcagacaacgcttagttgaaaagcgcgtgcatatgcgcgacgccttcccgcgccagttggaaggcgataagccacatcaccacccctaccagaatgttgataatgcgttgagctttcgccgtacgcagtcgaggcgcaagccaggccgccagtagcgctaacccaaaaaaccataagaacgacgcgctaatcgtgccgagagcaaaccagcgctttggctccatagccagttgtccgccgagactgcccaacacgacaaacgtatccagataaacgtgcggattcagccaggttaccgccagcatcgtagcaataattttccagcgcccctgcttcataacctcggcgctggccagctccagattactgctcattgccgttttcagcgcgccaaaaccgtaccataacaagaacgcaaccccgccccatgtgaccagcgccagcagccacggcgactgcatcagcaacgcgctaccgccaaaaataccggcgctaatcaggactaaatcacttaacgcgcaaagcagcgctatcatgaggtggtactggcgacgaattccctgattcatcacaaacgcattttgcgggccaagcggaaggatcatggcggcgccaagggcaaccccttgaaaataataagatatcacgttaactaccctgagctgtttttcttaaaggcagactatagcgcgggaatattattagcggaaattgataattttaatcactaataagaaaagctaataaagagactgaataacggatggcggctacgcttatccgctcaataaccagagaatactggaggcggataagcgcagcgccggcaggcagcacgggaggaaaattactccgcggcgttatctttcacgcgtttaaaattgacgtccatctgcgggtacgggaagctaataccagcggcgtcgaattcacgtttaatacgttccagcacgtcccaatagacattttgcaggtcgctgcttttactccagacacgcaccacaaaattaattgatgaggcgcccagctcattcaaacgcaccgtcatttcgcgatcttttaaaatacgatcgtcggactcgataatcgtcgttagcagctgtttcacctgatcgatatccgaatcgtaggccaccccaataatgaattcgttacggcgaaccggctcacgagaatagttgatgatatttcccgcgataattttgccattcggaatcacaataattttgccgtctaccgcgcgcattgtcgtggaaaagatttgcacgttcagtaccgtaccggcaacgccgcccaaatcgacatactcaccggcgcggaacggacggaacataaccagcaataccccagccgcaaggttagaaagcgatccctgtaatgccaggccaacggctaaaccagcggcgcccagtacggcaataaccgaggcggtttgaacccccacgcgacccagagccgcaatcagcgtaaaagcgataaccccatagcgcaccagcgcagaaagaaagtcggctactgtcgcatcaatatgacgcgcacgcatcagacgatttaccgtattggagatcacgcgcgctacaatcaagccgatgatgataatagcgatagccgcaacaatattcacagcatagctgagcaataacgcctggttgcgtaccagccaggtgcccgcaccatttatgctgtcgacaacattcaaatcttccattcaatattccttggtcatagcaaaacaagcaaatgagatcattctcacgaaaagaactttttaaaggtaaacaaaaacagaggaatatgccatttttcggcatcatcccaaaaaaggcaggtacactgtgagttggccggatgaaagcgctaactaacgccgctctccggaaataacgataataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaatggcttcccgagggaagccatttcaatcagcagactatattacagaacgtcaatcgcgttcagttctttaaatgctttttccagacgagcgatcatcgaagtctggccagcacgcagccatacgcgcgggtcatagtatttcttgttcggctgatcttcgcctttcgggttgcccagctgaccttgcagatacgcttcgttttctttgtagtaattcagaacaccttcccaggttgcccattgggtatcggtatcgatgttcattttcactacgccgtagcttacggagtctttgatttcctgagcagtagaaccggaaccgccgtggaaaacgaagttcaggctgttgtgcggcaggttgtgtttcttagaaacatagtcctgagaatcacgcaggatggtcggggtcagaaccacgttacccggcttgtaaacgccgtgtacgttaccgaaggaagcggcaatggtgaaacgcgggctgattttgctcagctcagtgtacgcgtaatcaacatcttccggctgggtgtacagagcagaagcgtccatgtggctgttgtccacgccgtcttcttcgccaccggtgcaacccagttcgatttccagagtcatgccaattttggacatgcgcgccaggtatttggagcagatttcgatgttttcgtgcagagactcttcagacaggtcaatcatgtgagaagagaacagcggtttaccggtagccgcgaagtgtttttcacccgcgtccagcagaccgtcgatccacggcagcagtttcttcgcgcagtggtcagtgtgcaggataaccggcacgccgtagtgttcagccatctggtgaacgtgatgcgcgccagagatagcgcccaggattgccgcgccctgaggtacgtcagttttcacgcctttacccgcgatgaaggacgcgccgccgttggaaaactgaacgatgaccggtgctttaacttttgcagcggtttccagaacagcgttgatggaatcagtgcccacgcagttaactgccggcagagcaaaattgttttcttttgctacctggaacactttctgtacgtcatcaccagtgatcacgcctggttttacgaaatcaaaaattttagacatgtttcgttgtcctgtatcgtcgggctttgggaaaaaacacgggccgccctgaatgtcagatcggcgataaatcaacgggcaggaatccctgcccgtaacgattacttcttagcgcgctcttcgagcatcgctacggctggcagaactttaccttccacgaattcgaggaatgcgccgccgccagtagaaatgtaggaaattttgtcagcaatgccgaacaggtcgattgccgccagggtgtcgccgccgccagcgatggaaaacgcttcgctatcagcgatggcattcgccacgatttcagtccctttacggaagttcgggaactcaaacacgccaaccgggccgttccacagaatggttttggcattcttgaggatttcagccagctgctgagcggaagcatcgccgatatccaggatctgctcgtcttctttcacgtcgttaacggatttcagagtcgctggtgcggtttcggagaactcggtggcaacgcgaacatcggtcggaaccgggatatcgcaagtggtcagcagacgttttgcttcgtcaaccaggtcagcttcgtacagggatttaccgacgctgtggccctgagcggcaacgaaggtgttggcgataccgccgccgacaatcagctggtcagcgattttagacagggaatccagaacagtcagtttggtagatactttagaaccaccaacgatagccaccatcggacgagccggctctttcagcgctttacccagtgcatccagttcagcggccagcagcgggcctgcgcacgcgacgtcagcaaatttgccgataccgtgggtagaagcctgcgcgcggtgcgcagtaccaaaggcgtccatcacaaatacgtcacacagggcggcatattttttagacagcgcttcgtcgtctttcttttcgcctttgttaaagcgaacgttttccagaaccaccagctcaccttcggccacgtcaacgccgtccaggtaatctttgaccaggcgaaccgggttagacagtttgtctttcaggtagttaacaaccggcagcagagagaattcttcgttgtactcgccttcggtaggacgacccaggtgggaagttaccatcactttcgcgccctgtttcagagccagttcgatggtcggcagagaagcgcggatacgcgcgtcgctggtcactttcccttctttaacaggtacgttcagatccgcacggataaaaacgcgtttcccggccagatccagatcggtcatcttaattacagacatggtgaatcctctcaatgatgcttaaagttttgtcgacgctgacgcgtcgagcctgaaaccaactgcggccatcgctaacgtggtgtcgagcatcctgttagcaaagccccattcattatcgcaccagaccagcgtcttgatcaggtgggcgccactgacccgggtttgcgtgccatcaacaatggcgctgtgcgggtcgtggttaaaatctatcgagaccaacggtgattccgtatagtcaactataccatgaaatgcaccttgtgctgctttttgcagcaactggttgacttcactagcttttactggttttttcaccgttacgcttaaatcgatcgccgtcacattaatggttggaacgcgcaccgcaatcgcctcaaaacggtcgttaaactgcgggaatatacgcgtaatgcctgccgccagttttgtatctaccgggataatcgactggctggccgcgcgcgtgcgccgtagatcggagtgatacgcgtcgatcacctgctgatcgttcatcgcggagtggatcgtcgtgacggtaccagactcgatgccgtaagcatcatccaacaatttaatgacgggaattatgcaattcgtggtacaggacgcgtttgagacaatacgatgttccgcacgcagttggttctggttcacgccaaaaacgacggtggcgtcaagatcgttgctgcccggatgagaaaagagcactttcttcgcgccagcggcaatatgcgcctcgccatgctcccggttgccatatacgcccgtacaatccaacacgacatccacgcccagttcgcgccacggcagatccgccagcgttcgttcatgcagaatacgaatgacatcgtcgccgacaaaaagctgctcgcgctcgtggcgaacctcccatgcaaaacgcccgtggctggtatcgtatttcaacaaatgcgccatgcctgcggcatccgccagctcgttgatggccaccacggtaatttccgcccgacgtccggattcatacaaagcacgaaccacgttacgcccgatgcgaccaaagccattaatcgctatgcgtacggtcataggtctcctgcaaggctatcccgattcagatgaggctgacagagtaatgcagcttatcgtcgagtaaaacctcacctgtcgcaaactgcgactgattggttaattgtcgaacatttaattaactgaaacgcttcagctagaataagcgaaacggggaataaaaggaatgtttgtccagtcgaagaagacagttatctgacctgcatcacatttcatggccgcttacgctgcaatttattccatatttaagaatcaccagtacatccgtcagatcttttcatcgtcgcgtcacaaatactgatttatatcagaaagcgctgtcgccagcgtctatattatcagcgccacgtccgagtctcggagtcctgtaacgatgactgtatctcaccacaatgcctctacagcgcgcttttacgcgcttcgtctgcttcccggccaggaagtgttttcccaattacacgcctttgtgcaacagaaccaattacatgccgcctggattgcagggtgtaccggcagtctgaccgacgttgcgctgcgttatgccgggcaagaagcgaccacatcgctcaccggcacgtttgaagttatctcgctaaacggcacgcttgaattgaccggcgagcatctgcatctcgcggtatcggatccctacggggccatgctcggcggccatatgatgccagggtgtaccgtgcgtaccacgctggagctggttatcggcgagctgccagcgctgacgttcagccgtcaaccgtgcgccatttccggttatgacgaactgcatatttcttcccgttaattgacgactctttaagaggtactttatggcgcgtcgcccgttttccagccagtctctggtgctgattgtcatcgctattgccatcaatatgattggcggacagcttattagcatgttgaagctgcctatttttctcgactcgatcggcaccttaattagcgcggtactgttagggccgttcatcggcatgttgactgggcttctgaccaacttgctgtgggggctgcttaccgaccctatcgctgccgcgtttgccccggtagcgatggttatcggtctggtcgccgggtggctggcgcgcgcaggctggtttcgtaccctgcccaaagtgatcgtcagcggggtcgtcattacgttggcggtgacgctggtcgccgtaccgcttcgtaccgcgctttttggcggcgttaccggtagcggcgctgatttgttcgtcgcctggatgcattcaatgggccaaaacctggtggagtcagtcgcgattaccgtcataggcgctaatctggtcgataaaattctgacggcgatcatcgtttgggtgctgctgcgtcagctaccgttacgtacgacacggcattttcctgcgatgtcagccgtacgctaaatgcatccgtttacctcgttaaccttatgggcgttggcggcctgcaccacgctgctactccctgcgcagaccgtgttcccggtttatagcgcggcggccttcctctgtctgctggcgctgaaatcaacgcggcggcgggcgaagtatgtcgcctggctgatgctgtctttagggtttgggctatggctggtacatggcggttggctaacggaatggataagcgggcagcctcgcgatccgcagcgctgggtatatgccgttacgctatggctacgtctgctggcgatcgtgtcgacgtcgcagctatggatgcagtatgtgccggttcagcggtttattcgcgccctgttcgcttcacgtctgccacccggcatcgcttacctgttcgctggcccgctgctggtcgtcgaacagctcaaacgacaactgacgatcgttcatgaagcccagcgcgcgcgcggcgtaccgctggatgaaggctggtatcagcggctacgggcaatgcctgcgctgatcgtgccgcttacgcaaaatgcgcttaacgatctgacaatacgcggcgcggcgttggatatgcgggggtttcggctgcatcgagcccgaaccacgctgtgggcgccgaaagatagcatgttacaacgggttgcgcggtatggcatggtactgctaatactggcggaagcgggagtatggatatggttacgttagagcagtttcgttatcttccgtccgatgcgacacgcccgccggcatgttttgatttccactattcaacacccggaatagtggcgatagtcggcgataacggcagcggaaaaagtacgctggcgcaactgatggctggctggtatccggattatctccccggcgatattgacggcacaggcctactgcttggcgtacctatcgggcggctcccgctggtagaacagtcgcccaccatccacctggtgcagcaatcgccttatttacagctttccggctgtacctttagcgtagaggaagaggtggcgtttggcccggagaatctcggcctccatgaagcggaaattctacggcgcattgacgaggcgctgactctgacaaactgccagtcgttacgccatcgccatcccggcacgctctccggcggcgaaacgcagcgggtagtgattgccagcgcgcttgccatgcagcccagattattagttcttgatgaagccttcagtcggctgacgtcagcggccaccgggacactgctggaacggttacaacagtgggcgctggaacgtcattctctcattgtgctttttgagcgtaatcatttcccctttctgacgcgatgccagcgggtatggcaattgcgcaacggagcgctaaccccattatgttgacgttaaatcaggtcgcttatcgctggccagatgccgcagccgactgtctgcacgccatctcgcttgaacttcgtgacggcgaatggctggcgttgaccggcgataacggcgcgggaaaatcaacgctgttacggattatggccggcctgctttcccccacttccggctcggtaacgcttaatggagagccgattgcgcagcttaaaaatcgtcaacgcgccgccgctatcggcgtactctttcaggaagcggaaaaccagattttccacagcaatgtcgcacaagaggtcgcttttgggctgaaactacagcgcttatcggcggaggatatttcacggcgcacgcaggccgcgctgcggttatgccagctaacggacgtcgccgaggcgcccccgcttgatctgcacgccgcgcagcgccggatggtggcggtcgccagtctggaggcgatggcgccgccggtgttattgctggatgaacccagccgggattttgacgcccactggctaaccgtatttgaacactggctggcgacatgccgggcacggggaaccagcgtcgtggcgattagccatgacgctgcgtttacccggcgtcatttttcccgggtggtacggctggaaaacggcaggttgtcaaagggggaataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcgcaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaacgggtcgccgaagcgacccgttttatgccgtattaaggattacagcagcgctttcgctttggcgatcacgttgtccaccgtgaagccaaactcttcaaacagcagctctgccggggcggattcaccgaaggtggtcatcccgacaatagcgccgttcaggccgacgtatttgaaccagtagtcagcgatacccgcttcaatcgccacacgcgcagagaccgctttcggcagcacggattcacggtaggccgcatcctgcttgtcgaacgcgtcggtggacggcatggaaaccacgcgcgccttcacgccttcggcagtcagtttttcgtaggcggcaaccgccagctcaacctcagaaccggtcgcaatgaagataatctgcggctggcccgcacaatctttcagtacgtaaccaccgcgggcgatattcgccagttgctcttcagtacgctcctgctgcgccaggttctgacgggacagaatcagcgcggttgggccatcctgacgctctatgccatatttccacgccaccgcggattccacctggtcgcacggacgccatgtggacatgttcggcgttacgcgcaggcttgccacctgctcgaccggctggtgcgtcgggccatcttcgcccagaccgatggagtcgtgggtatagaccatcacctgacgctgtttcatcaacgctgccatacgcactgcgttacgggcatattcgacgaacatcaggaaggtggaggtgtacggcaggaaaccgccgtgcagggcgataccgttggcgatagcggtcataccgaattcgcgcacaccgtaatgaatgtagttacctgcggcatcttcgttaatcgctttcgaaccggaccacagggtcaggttagacggtgccaggtcagcggagccgccgaggaattccggcaacagcggaccgaaggcttcgatggcattctgggacgctttacggctggcgattttggatggattcgcctgcagtttagcgatgaactcattcgctttcgcattgaagtcagccggcatgtcgcctttcatacgacgagtgaattcagcagcttcctgcgggaaggctttctcataagccgcgaatttctcattccatgcagactctttcgcctggccggcttctttcgcatcccactgggcgtagatttcagacgggatttcgaacggcgcgtatttccagcccaactgttcgcgggtcagcgcgatttccgcgtcgcccagcggcgcgccgtgggaatcgtgggtaccctgtttgttcggcgaaccgaagccgatgatggttttgcacatcagcagggacggtttgtcagtcacggcgcgagcttcttccgtggcacgtttaatggcgtcggcatcgtgaccgtcaatgccacggataacgtgccagccgtaggcttcaaaacgtttcgcggtgtcatcggtgaaccagccttcaacatgaccatcgatagagataccgttgtcatcatagaacgcgatcagtttgcccagtttcagagtaccagccagagagcacacttcgtgagaaatgccttccatcatgcagccgtcgcccataaagacgtaggtgaagtggtcaacgatgtcgtggccaggacggttaaactgcgccgccagagttttctcggcaatcgccatcccgacggcgttggcaataccctgccccagcgggccggtagtggtttcaacgccagcggtgtagcccacttccgggtgaccaggggtttttgaatgtagctgacggaaattctgcagttcggacatcggcaggtcataaccggtgaggtgcagcaggctgtaaatcagcattgagccgtggccattggacagcacgaagcggtcgcggtcggcccaagacgggttggtcgggttgtggttcaggaaatcacgccacaggacttcggcaatgtcagccatacccatcggggcacccgggtgaccggatttggctttctgtactgcgtccatgctcagcgcacgaatagcattggcaagctctttacgtgaggacattttgactccagatcggatgttgaaaggccatgcccgtaacgacttgacgacagcgcgttttgggctacgccggaaaatttgccaacaatttaccccaagccgcgcgtcatgtacatggaacatccttttaccgcttcagaaatctccggatcgtgctcgcatgttgcgcaattagctaacttgcctgccacgcttttctttatacttaacccaggcgctaattcatctgcaacgggcgcatttcaaaataatattaattcgtatggaagagaaaaatgaaaattcgcgctttactgcttgctttgggcatggcgacggtgctgaccggttgccagaatatggactctaatggactgctttcttcgggcgctgaagcttttcaggcctatacgttaagcgatgcgcaggtaaaagcgttgagcgatcaatcctgtcaagagctcgacagcaaagcgaaaatcgcgccggcgagcagcgaatacactaaacgactggcaaaaattgccgccgcgctgggggataacattaacggccagccggtgaactataaagtttacgagacgaaagacgtcaacgcgtttgccatggcgaacggttgtatccgcgtctacagcggactgatggatatgatgaccgacaacgaagttgaagccgtgatcggtcatgaaatgggccatgtcgctctgggtcatgtaaagaaagggatgcaggtcgcgctgggcactaacgccgtgcgcgttgcggcggcatcggcaggaggcgttgtcggcagcctgtcgcaatcacagcttggcgatcttggcgaaaaactggtgaactcgcagttctctcagcgtcaggagtccgaagcggatgattattcttacgatctgttgcgcaaacgcggtatcagtccggcaggactcgccaccagctttgagaaactggcaaaactggaagcgggtcgtcaaagctcaatgttcgacgatcacccggcgtccgccgcacgcgcacagcatgtgcgcgatcgtatgagcgcggacgggatcaaataatccccgaacagtgccggatggcggcgtgaacgccttatccggcctacacaggcccggtaagcgtaggccggataagcgcagtgccatccggcaaaacaacttactcgcccttcttcgccgcctggatatagagcatttctaatgccagcgtcgcggccgccagagcggtgatctccgactgatcgtaagccggcgcgacttccactacatccataccgacaatgttcagatctttcagaccacgtaccagcttaatggcgcgatcggaggtcaaaccaccgatcaccggcgtaccggtgccaggcgcaaacgccgggtccagacagtcgatatcaaaggtcagatagaccggcatatcgccgacgatctgtttcacctgagcgagaatatcatccacgccgcgatcgttgacctggcaggcatccagcacggtaaagccattgtctttgtcaaactcagtgcgaataccgatctgtaccgaatgatgcggatcgatcaggccttctttcggcgcggtgtagaacatcgtgccgtgatcgaattcgcagccgttagcgtaggtatcggtatgcgcgtcaaaatgtaccagcgccattttgccaaaatgtttcgcgtgggcgcgcagcagcggcagcgtgacgaagtggtcgccgccgaaagagagcatacgcttgcctgcagacagcagtttttcagcgtgcgcctgtaatttttcgctcatttcacgggcatcgccaaacgcatacaccagatcgccgcagtccacgacgttcaggcgctcgcgcatgtcaaaattccacgggaaacggtgatgttcccaggcgaggttggtcgacacctgacggatcgccgccgggccatgacggccgccagcgcgaccggacgttgccatatcaaacggtacgccagtgatcacccagtcggcatcgctgtcatacggctggaagttcattggcagacgtaaaaaaccaaacgcattagaaaccagtgagttatcgtactgatgacctaaagtgctcatgtcctgacctcttttagagtcgttgcattaaaacagatgaaaaaaatcccctccgcgtcgttaaacccgacgaggaagggattgatttgtaaatcgctattgcagcgaattatcgccgttaattcatacgggttcaagtgagtatagcattctgccgggtggcggctttaccttatccagcctgcattcgtaggcccggtaagcgcagcgccgccgggcatcaacggctactcatcttcaagataagtataaccgtacagtcccgcttcaaattcctcaaggaactgctgctgcaacgcatcgtccagatccgtctgttttacctggtcgcggaaatgcgttaatagcgttttcggatccagttgcacatattgcagcatatccgcaacggtatcgccttcgtccgacaactcaacctcgacactaccatccgggaagacaaacacgtcaaccgcttcagtatcgccaaacaggttgtgcatgttaccgaggatctcctgataggcgccgaccataaagaagccgagcatcggcggattctctggatcgtattccggcatcggcatcgtcgtggcgataccgtcgccatcgatatagtggtcgatagcgccatcggaatcacaggtaatatccagcagcacggcacgacgttccggtacctgatctaacccttccagcggcagcaccggaaagagctgatcgattccccacgcgtccggcatcgactggaacagcgagaagttgacgtacattttgtccgccatccgctcttgcagttcgtcgataatcgggcgatgcgcacggttttgcgggtccagttgcttctgcacttcatggcacatgctgagataaagttgctccgcccaggcgcgctcctgcaaactaaacgcgccggaagagtagccgatatgaatatcgtgcagatccatttggctatcatgcagccattcacgcagcgagcggcgggtgccaggcttatgcatctcctgccaggtttcccacagattttgcagcgcgcgcggcgcatcttcagcaggggcggtcggatccgtgtattcgttacgctccacgccgataatgttagagaccagtaccgtatggtgcgcagtgacggcgcgcccagactcggtaatcaccgtcggatgcggtaaaccatgctcttcgcaggcatcgccaatcgcccagatgatgttattggcatattcgttcaggccatagttcaccgaacagtcggactgcgagcgggtaccttcataatccacgcccagaccgccgcccacgtcgaagcactggatattaacgcccagcttatgcagctcaacatagaaacgcgcggactcgcgcacgccggtcgcgatatcgcgaatgttcgccatctgcgatcccaggtggaagtgcaacagttgcagactgtccagacgcccagcgtcacgcagggtctccaccagttgcagcacctgcgtcgccgccaggccgaattttgatttttcgccgccggaggattgccacttaccggacccctgagaggccagacgcgcacgcacgcccaggcgaggaaccacgttcaggcgctcggcctcttccagcacaatcgcgatttcagacatcttttcgatgaccagataaaccttatggcccatcttctcgccaatcagcgccagccgaatatattcacggtctttataaccattacagacgatcacgctacgggtcatgccggcatgcgccagcaccgccatcaattccgctttcgaccccgcttccagccccaacggttcaccggaatggataagggactcgatcacgcggcgatgctgattgaccttaatcggataaacgaggaagtagtcgccgttataaccgtaagattcacgcgcacgcttaaacgccgcgttaattgaacgcaaacggtgttgcaggatctgcgggaagcagaacagcgccggcagacgctgaccttgcgcttcgcgcgctttcaccagtttggcaagatcgacacgcgcttccggtacgtcgggatcggggcatacgctaatatggcccagctcgttgacgtcgtagtagttattgccccaccaggcaatattgtaagtgcgcagcatcttgctggcttcctgggagctcattgcaacctcctgcatggagcgtagtacaccctgttcgcctgctgacgaaggcgaacccatagacatgtcgtcagacatagcgaacctcaatttttattagcaagtgtaaaacagttgactactatcgcaatccgaagacgcgataacaacccatagacaagcggattttccagcagatagcgctgatgctccgcctgcgcgaccggtttctttttcatatcattgtaaacacgtaaccgaactcacagataacggttcggcgaaaccacgagaaaactcttgcgttaacaagagcgcccttgttcagtcttcagcgccattgccggctctggaatcctgagaagcgccgagatgggtataacatcggcaggtatgcaaagcagagatgcagattgcgggagacatgcgcgcaccagaacgatgcgacagattcagcagaatacaacggttcattatctcgtatcacctccacggccgcctcgtaagacgaacccacaagccaaagcaacgttttaacccggctggaagtggcgacacgaagaaaacgtcgtgtgcttttgtatgagccgcgcgtcgcgttttatacccagaacgcagaaaaaaagcaaagcataaatgcgcataatgtcagcattatcagaaacgtttaccgcctgattttgaccgacattgcgacggccttcaaaaaaagctggaaattgggcgaagaagtgacctaaaatagccgtccagatgttaatccatccatactgattaacactcagactgccagtgttagtaaccttcagactcatggtagaatcttctgtcatgactattccgcacaacagtttgagctaactaaattctccttaggtgaaattaaatatggcaaaacacctttttacgtctgagtccgtatcagaagggcatcctgacaaaatcgcagaccaaatctctgatgccgtgttggacgctatcctgcaacaggatccgaaagcacgcgtcgcctgtgaaacctacgttaaaaccggcatggttttagttggcggtgagatcaccaccagcgcctgggtcgatatcgaagagattacccgtaatacggtgcgcgaaattggctatgtgcattccgacatgggctttgacgccaactcttgcgcggtactgagcgcaattggcaaacagtctccggatatcaaccagggcgttgaccgcgcagacccgctggaacaaggcgcgggcgaccagggcctgatgtttggctacgcgacaaatgaaaccgacgtactgatgcctgcgccaatcacctacgcgcaccgtctggtacagcgtcaggctgaagtgcgtaaaaatggcaccctgccatggttgcgtccggatgcaaaaagccaggtcactttccagtatgacgacggcaaaatcgtcggtatcgacgccgtggttctctctacgcagcacgcagaagatatcgaccaaaaatcgctgcaagaagcggtgatggaagagatcatcaaacccattctgccgtctgaatggttaaatacgtccactaagttttttatcaacccaaccgggcgttttgttatcggcggcccgatgggcgattgtggtctgaccggtcgtaagatcatcgttgatacctacggcggtatggcgcgtcacggcggcggcgccttctccggtaaagatccgtctaaagttgaccgttctgcagcttacgctgcgcgttatgtcgcgaaaaacatcgtggcggcaggtctggcggatcgctgtgaaatccaggtctcctacgctatcggcgtagcggagccgacgtccatcatggtggaaacgttcggtactgaaaaagtgcctgctgaacagttgattctgctggtgcgcgaattcttcgacctgcgcccgtacggcttgattcagatgctggatctgctgcacccgatctacaaagaaactgcggcttacggccacttcggtcgcgaaaacttcccatgggaaaaaaccgacaaagcgcaactgctgcgcgatgctgccggtctgaaataatcgcccgcgcctgacgctgtttttcagtcaggtaaaccataccgtacttatcaaggccagcgccctgctggcctttatcattgctgatacacgcaacgttattagatgttccagcgtgtatttatactgacctttttgtgatgcgcagcacaatccgctctcctctttcgtttcttcgactacacttttcatcattcagtttcagcagctatgaaagcggttacattcattttcattgagaactgaccacctcactgtcggtatgctaactctgcgatgaaaatgttacatagtttttcagctttgtctgaataccaggcgattgatagggttataagattattaaaactattatttttcagataattaaataatcaccgagataaatagtagtgtaaacgattacaccattgtgattagcctcacatctttttacggcgtactcacctactcttaacatcgataaaattgctaacccaaccggagggcataatgcctgacaataaaaaacaagggcgttccaacaaggccatgacattttttgtctgctttcttgcagccctggcaggattactttttggcctggatatcggcgttatcgccggtgctttacccttcattaccgacgagtttcagattaccgcacacactcaggaatgggtggtcagctccatgatgtttggcgcggccgtcggcgctgtcggcagcggctggctctcctttaagctgggtcgtaaaaaaagcctgatgatcggcgctatcctgttcgtcgccggttcgctgttctccgctgcggcgcctaacgttgaagtcctgattatttctcgcgtgctgctgggtctggccgtcggcgtcgcttcctacactgcaccgttgtacctgtccgagatcgcgccggaaaaaattcgcggcagtatgatctcaatgtaccaactcatgatcaccatcgggattctgggcgcttatctgtccgataccgcgttcagctacagcggcgcatggcgctggatgctcggcgtgatcatcatcccggccattctgctgctgatcggcgtcttcttcctgccggacagcccgcgctggtttgcggcgaaacgccgtttccatgatgctgaacgcgtcctgttgcgcctgcgtgacaccagtgcggaagcaaaacgtgagctcgatgaaattcgcgaaagtttgcaggttaaacagagcggttgggcgctgttcaaagagaacagcaacttccgccgcgccgtgtttcttggcattttgttgcaggtaatgcagcaatttaccgggatgaacgtcatcatgtattacgcgccgaaaatcttcgaactggcggggtacacgaataccacggagcagatgtggggcaccgttattgttggtctgactaacgtgctggcaaccttcatcgctatcggcctggttgaccgctggggccgcaagccgaccctgacgctgggcttcctggtcatggcgattggtatggggattctgggtacgatgatgcacatcggcatccattcaccgtctgcgcaatacttcgctatcgctatgctgctgatgttcatcattggatttgcgatgagcgctggtccgctgatttgggtactgcgctccgaaatccagccgctcaaaggccgcgatttcggcatcacctgctccaccgcgaccaactggatcgccaatatgatcgtcggcgcaacgttcctgaccatgctgaacaatctgggtaacgccaacaccttctgggtctacgctggcctgaacgtgctgtttatcctgctgaccctgtggctggtgccggaaaccaaacacgtttcgctggaacacattgaacgtaacctgatgaaaggtcgtaaactgcgcgaaatcggcgcccacgactaatccctccacgcttcctcctgccacaggaggaagcgtttttcttgcagtccctcttccgtcgcactattctctgccgctatgaaaacccctcgtctccctatcgctatccagcaggccgtgatgcgccgtctgcgggaaaatctcgcccaggcgaacctcaagctcgatagacattatccggagccgaaactggtgtatacgcaacgcggcacctcggcgggcaccgcctggctggagagctacgaaatccgcctcaacccggtgttactgctggaaaacatcgacacctttattgcagaggtcgtgccgcatgaactggcgcatctgttggtgtggaagcacttcggacgcaaggctccgcatggcaaggaatggaagtggatgatggaaagcgtgctgggcgttccggccagacgtactcatcaatttgcgctgcaatccgtacggcgcaatacctttccctaccattgccaatgccagcaacatcaactcaccgtccgccgtcataaccgtgtggtacgcggcgaagcggtttatcgttgcgttcactgcggcgaaccactggtcgccgggtagttccccgaaacgtccgggaactttcctgagcggactgattgcatacagacacaactttcgctacgttgcgggctcgttttgctatggagtgtgcaatgtaccgtaatttttcttttgctgctgcgttgctggccgcagcgttttcaggccaggcattggccgacggcattaacaatttttctcaggccaaagcggcgagcgtcaaagtcaatgccgacgcgcccggcagcttttactgcgggtgccaaatccgctggcagggtaaaaaaggcgtcgtagacctggagtcctgcggctataaggtgcgtaaaaacgagaatcgcgccagacgcattgagtgggagcacgttgtccccgcctggcaattcggtcatcagcgccagtgctggcaggacggcgggcgaaaaaactgcgctaaagacccggtctactgcaaaatggaaagcgatatgcataacctgcaacccgcgattggcgaagtgaatggcgatcgcggcaactttatgtatagccagtggaacggcggcgaaggtcagtacgggcagtgcgccatgaaagtggattttaaagcgaagctcgccgagccgcccgcccgcgcccgtggcgcaatcgcccgcacttatttttatatgcgcgaccaataccaactgaaactttcccgccaacaaacgcagctttttaacgtctgggataagcagtaccccgttaccgcctgggagtgcgagcgcgatgcgcgtatcgcgaaggtccagggtaatcataatccctatgtgcaacgcgcttgccaggcgcgaaagagctaacctacactagcgggattcttgttaacccatgccctggatagccaaacgccggggccatgacgcggatttttttattatgcgtattccccgcatttatcaccctgaattgttgacgtccggtacgcagatttcgttatgcgaagatgcggccaaccatattggtcgtgtactgcgcatgggagcgggacaagcgttacagctgtttgacggcagcaatcaggtattcgatgctgaaatcattagcgccagtaagaaaagcgttgaagtgcaagtgatgaaaggcgaaatcgacgatcgtgaatcgccgctacatatccatctgggccaggtgatgtcgcgcggtgaaaaaatggaatttactatccagaaatcgatcgaactaggtgtaagcctcattacgccactgttctctgagcgctgtggcgttaaactggataatgaacgtctgaacaaaaagcgccagcagtggcaaaagatcgccatcgccgcctgcgaacaatgcgggcgtaaccgggtgccggaaattcgcccgccgatggcgctggaagcctggtgcgccgagcaagattccgggctgaggctcaatcttcatccgcgcgcccatgccagcatcaacactctgccgctgccggttgaacgcgtccgactgctgatcggcccggaaggcgggctgtcggcggacgaaatcgcgatgaccgcgcgctatcagtttactgatattctgttaggacctcgcgttctgcgtactgagacaaccgcgctcaccgccattaccgcgctacaggtgcgttttggcgacttaggatgaagcgttaacggagaaaataatgatcaagctcggcatcgtgatggaccccatcgcacacatcaacatcaagaaagacaccagtttcgctatgctgctggaagcccaacgtcgtggttatgaacttcattatatggagatggccgacctttatctgattaacggcgaagcccgcgcctgcacgcgaacgttgagcgtggagcaaaattacgataaatggtacgagttcggcagcgagcaggagattaaactcgccgatctggacgtcattttgatgcgcaaagatccgccgtttgataccgagtttatttatgcaacctatattctggaacgcgctgaagaggaagggacgcttatcgtcaacaaaccgcaaagcctgcgcgactgtaatgaaaaactgtatactgcctggtttgccgacctgacgccggaaacgctggtaacgcgcaataaagcgcagctcaaagcgttttgggaaaagcacggcgatatcattatgaaaccgctggacggtatgggcggcgcgtccattttccgcgttaaggaaggcgatcctaacataggcgttatcgccgaaacgctgaccgagctaggcaaccgctactgcatggcgcagaactatctgcccgcgatcaaagatggcgataagcgcgtactggtcgtcgacggcgagccggtgccttactgcctggcgcgtattccgcagggcggcgaaacccgcggcaacctagcggctggtggtcgcggcgaaccccgtccgttgagcgaaagcgactgggaaatcgcccgccgcgttggaccaacgcttaaagccaaagggcttatttttgtcggtctggatattatcggcgaccgcttaacggaaattaacgtgaccagcccaacctgcgtgcgtgaaattgaagcggaatacccgatctctatcaccgggatgttgatggacgccatcgaagcgcgtctggcgaagtaaaagtttattgcccggtggcgtgcgcttaccgggcctgagcaatcacgccgccccggtcggataaggcggcgcgtcagcatcgccatccggcagtctattgcccgataaggccgccgtcctttggcaaaagacggcttatatgagtgacaaccgtccgctttccccacatactgaacgctgtcgtttttttgaaccaggaaacagaacctctgacaatgaatttacagcatcactttcttattgccatgcctgcgctccaggacccgattttccgccgttccgtggtgtatatttgcgagcacaaccaggacggcgctatggggattattattaataagcctttggaaaatctgcaaattgaagggattctggaaaaactaaaaattacgccggaaccgcgcgattcggcaattcgtcttgataaagccgtgatgctcggcggcccgctggcggaagatcgcggatttattctccatactccgccgtcacgtttcgcctccagcattcgtatctcagacaataccgtgattaccacctcccgcgatgtgctggaaacgttaggtacccaacaacagccttccgatgtgctggtcgcgctgggctacgcctcctgggataaaggccagcttgaacaagagttgcttgataacgcctggcttaccgcgcccgccgatctcaatattttgttcaaaacgcccattgccgagcgctggcgcgaagcggcaaaacttattggcattgatattctgaccatgcctggcgttgcggggcacgcctgatgagcgacaccttactggcctttgacttcggcacaaaaagcatcggcgttgcaataggacaacgcattaccggcaccgcccgtccgcttccggcaatcaaagcacaggacggcacgcccgactggacgctcattgaacgtttgctgaaagagtggcagccggacgaaattattgtcgggctaccgctcaatatggatggcactgaacaaccgctgacggcgcgcgcccgtaaattcgccaaccgtattcatgggcgcttcggggtaactgtcacgctacacgatgaacgactcagcaccgttgaagcacgctccggtctgtttgaacgaggtgggtatcgcgcgctgaataaaggcaaagtggactcggcctccgccgtgattatcctcgaaagctattttgaacaggggtattaaagccgtttttgtcagcaggcggataacgcggtcacggttgccaggcttactgggcaataagctggtttaatgccttcaacgcctgtaaacgcgcagccgcctccgcctcatcaatccgccacattcccgcaaaggccagcgctgcggcgtgcttgtctagcggttgcgccatagaaacttcaccatcagcgtgatgccacagcacgtatccccgctggcgctgctgcgccacatgcggtgccagattacgccactgctccggactaaaacgctgcattagcgcctcatcgctttctgccgccagtaacgccaccccaggtaccgactgccaggccaggcacatgcgaaaccccgccagcgcctgacttccctgcgcccccggcgtagagtgataaatatagataatctggtcttcccatagcacgcctaatgccaccacgatgtctctgggcgcatgtcgctcaaggataggcaacgcatgggagaacagcgctgaaccgcgaatcgcctgcgccgccaaagcatgaatgcctggcccgggtaaatagcgtcggtgctcatcctgcatcgtgagtccaatagaggccatcgtcattaacaggcgattaacgcgcgtggtattaatatccatcagccgggcaagctcgcgacatccgatagcacggtcgctggagaccagatattgcagacagcgaatgccatctatcaggctttgattcggttgtgatgacatcgttaaatgacttcgctgtggttttaacaaagctgcgattttaacgccggttcgccaggatacaagcctgtatgccgttcaatccaccgcgccagtcaacacttccccttccctacgccgccatcttcgctacagccgtccctgcgcctgacgccattgcgcgctctgggcgaatgtcatcatcccctgctgctgcccggtttgtatcacgtgggccaactgatggagtttgccttcacggatcaaattccctgtggctggcgtattaatcagtaattcaaacaacgccacgcgcccatcctgtctgtcgacctccagtttttgcgatagtacggcgcgcagactacccgccagttgactgcgtaccggttctttttcctgcgccggaaaactatccactaatctttccaccgcctgcgccgcgccgcgagtatgcagggttgccagtaccagatgccccgtttccgccgccgtcagcgccaggcgaatggtctcgctgtcacgcagctctcccagtaaaatgacatcgggatcttcacgtaacgccgcgcgcagcccggcggcaaaagtggcgcaatgctggccgatttcccgctgctgtatcaggcaacgcttgctggtgtaacggtactcaataggatcttccagcgtcaggatgtgtttatcggcatgttgattaagatgtcccaccatcgccgccagcgtagtggatttcccgcagccagtagcgccagtgaccagaatcagtccgttctcgctggcaagcagtgcgggtactatcggcggcgtctggatttccgccagatcaggacaacgctcgggcaatagccgtatcgccagcgacgttccctgttgatgtgtgaacgcactggcgcgcaggcgccgcgtgccagacagcgagacggcgaaatcaagctgaccgtgcgttcgccactgatattgttgcgcgtcattaagccaatcaagcagaagcctgtcgacatcaggcgcggtaaaaggcgcggtctccatgcgtccttgtttgcgccatcgcgcaggccaggcgttacacaggtgtagatccgagacgttatgctttacactaagcgtcacaatttcttccatattcatataaacatcctcggaaaatgaacgatatcgcgcataacctggcacacatccgggacaaaatctccgccgcggcgacgcgttgtggccgctcttcagaagaagttacgttgcttgcagtgagtaaaaccaaacctgcgagcgacatcgcagaagccattgccgccggacaacgggcatttggtgaaaattatgtacaagagggggtggaaaaaatccgccactttcaggaagcgaaagtggaaggcctgcactggcactttattggccctttacagtccaacaaaagtcggctggtggccgagcattttgactggtgtcataccatcgatcgcctgcgtatcgcctcgcggctgagcgaacagcgcccggataatctgccggcgctaaatgttctgatccaaattaatatcagcgatgaaaacagcaaatcaggcattccgctggcggaactggatgagctggccgctgcggtggctacactgccgcgtctgcggcttcgcggactgatggcgatcccggcgccagagtcagattatgtaaggcagtttgaagtcgcacgtcaaatggctgtagcatttgccgggctgaaagcgcgctaccctgacgttgataccttatctctgggtatgagcgacgatatggaagccgcgattgcggcaggtagcacaatggtgcgcatcggcaccgctatctttggtgctcgtgattacacaaaaaattaaggaaaactgaggaacgccatgaatacgttgaccttcctgctctcaacggtaattgagctgtataccatggtgctattattgcgcgtgtggatgcagtgggcccgctgtgacttttacaaccctttttcccagttcgtggtgaaaattacgcagcccatcatcggaccgctgcgtcgtattatcccgccaatggggccgatcgacagcgcttccctgctggtggcgtttattcttagcgttattaaggcgatagtgctgtttaaggtaattacgtttcaggcgattatctggattgccgcggtgcttatcttacttaaaacaatcggcctgctgatcttctgggtgctgctggtcatggctatcatgagctgggtgagccagggtcgtagcccgattgaatatgtattgattcagcttgccgagccgctgctcagcccgattcgccgtatactgcctgcgatgggcggcatcgacttctcgccgatggttctggtgctgctgctgtatgtcgttaatatggggatcgctgaagtcttacaagcgacaggcaacatgttgctgccggggctgtggatggcgctatgagtgctgtgactcgctgcgaagacggtctggtgttacggctttatattcagccgaaagccagccgcgacagtattgtgggtttacatggcgacgaggtgaaagtcgccattaccgccccgccggttgacggtcaggcaaacagccatctgaccaagtttctcggtaaacagtttcgcgtggcgaaaagtcagatcgtcatcgaaaaaggcgagctgggccgtcacaaacaggtaaaaattattcacccgcaacagatcccgccggaaattgcggcgttaactgagtaggtattccatgcaaaaagttgttctcgcaaccggcaacgccggtaaagtgcgcgagctcgcgtcgctgttaagcgattttgggcttgatgtggtagcgcaaacgaaactgggcgttgactctgcggaagaaaccggcctgacgtttattgaaaacgcgattctcaaagcgcgccatgccgctaaaatgaccggtctgcccgccattgccgatgactccggtctggccgttgacgttttaggcggcgcgccgggtatctattccgcgcgctattctggcgaaaacgcgacagatcagcaaaatctggaaaaactgctgcatactctacgagatgttccggacgacaaacgccaggcgcgattccattgtgtactggtttatttgcgtcatgccgaagatcccacaccgatagtctgtcacggtagctggcctggcgtcattactcgccaggcggccggaaatggcggatttggctatgatcccattttcttcgtaccgtctgaaggcaaaaccgccgcagaactgacccgtgaagaaaaaagcgcgatttcccaccgtggacaagcgctcaagctgctgctggatgcgttacgcaatggctaaactaccgccgctcagtctttatattcatattccctggtgtgtacaaaaatgtccatattgcgacttcaattcccatgcgttgaagggcgaggtgccgcatgacgactacgtccagcatctgttaagcgatctggatgccgacgtcgcttgggcgcaagggcgtgaagtaaagaccatttttattggcggcggtacgccaagcctgctttccgggccggcgatgcaaacgctgctggacggcgtgcgtgcgcgcctgaatctggcggcggatgcggaaattaccatggaagcgaaccccggcacggtcgaagccgaccgcttcatcgactatcagcgcgccggcgtaaaccggatctccattggcgtgcagagctttagtgagcctaagctgaaacgtcttggccgtattcacggtccacaagaggcgatgcgggcagcaagactggcaaatgggcttgggctacgcagctttaacctcgacttgatgcatggattgccggatcaaacgctggaagaggcgctgaatgatttgcgacaggcgattgcgcttaatccgccgcatctctcatggtatcaattgacgattgaacccaacactttgttcggttcgcgtccgccggttttaccggacgatgacgcgctgtgggatatctttgagcagggccaccagttattaaccgccgcgggctatcagcaatacgaaacgtcggcctatgccaaacccggttatcagtgccagcataatctgaactactggcgctttggcgactatctgggtattggctgcggcgcccacggtaaagtcaccttcccggacggcaggatcttgcgcaccaccaaaacccgtcacccacgcggttatatgcagggacgttacctggaaagccagcgtgacgtgagtgatgacgataaaccctttgagttctttatgaaccgttttcggttgctggagcgcgcgcctcgcgccgaatttgtcgactacaccgggcttacggaagcggttattcgtcagccaatcgacgaggctattgcccagggctacctgacagaatgcgagcaatactggcagattacccgtcacggtaaactgtttttaaactctcttcttgagttgtttctcgcggaataacaaggataagcctgtcgcgccagcgggtaaaatacctgatggcgcgacgcttaccgacctgtggcggttaatgcgccaccagcaagcgcattatttaataacgcctttacgacgcaaatcgtccgtatcttttttccagcgctcgtaaccgtcattaatatccatgattttcatgcggatatcactctgttgcatctgaagtttctgtaccgctatattcagcggatattgccctttctctaacgttatccagtcattctgcgcttttcgacgcagctcttctgatttcaaaaatacctgccgccgttgctcgtgtatgtctaaatctcttttctgctgaatagccgcttcattgcacggctcactctgcttacgacacgcgtctaatgctggttgatagacctctttttcgtatttctcggcatatacgctgctatcgttggcttttacataatcatcgcgctcttttaacgtctttttaaacgcctcggcgcgggtcaacggtttcccatcagcgccttttccccaatatgcgtccgcttcttttttagctaccgctattttcttatccagggcagagagttgttcttcaagaccggggatcgacgctttctgcgcacgccaggaggcttcaatgttgccaaaccgatagttaaagtcatcactgttgacgatcaggtatttatcattcgttttaatgtcgtcaatagcccggccctgatcgctggctgccatttgtaatgagtaatagctcaccgtccagccagaggctggcgtccctttgctggttaacatggcagaaaatttaacgggacgatctttggtccaggttttttcaacaaaataataatccgccgccataccaacgccggtatacatatcttcacgggaagaaatatccccttcggcagaccaggtggcctgattgcccgtcgaatcaagattttttaaggtaatggaatccagtttaagtatgccgtggtactgcttactaaactgttcttttaagatgttatcggagggttgagcaacctctgcccaactatagcctgaaatcagggcaaacagcgctgcgccagcaatccattgtcgaaccacttgtggacctcccgtccagagacatgacgcccacaattatcataaccaggatgataattagcaagataatagtgttggttgtgcgagaggtcttccaaagatggccccggccttccgaccggggcattatctttaatactgattgaacatcgtctggatctgttttggatctttagtctgggttaacgccagttgcagtaagacacgcgctttttgcgggttcagcgtgccggaagcgacaaagccgtattttgcatcgtcaacttccgcatcctgcgtggttgcgccagtcggcacacgtgaagaacgcaccactaccgtaccgttgtgcgcggcggtcgctagggtatcaaagaccgttttatacaggttgccgttacccacgcctgcgctcacgatcccgtcataacccgcgtctaccagcgcttttgccggcagatcggacgcattcgcatagttataaacgataccgactttcggcaacgcggtcagcttcgacacgtcgaacggggtggaggtggtatgtttacgctctggcgtacgctggtagtcaattttaccgttgtggatataacccagcgggccgtagttaaccgctttaaacgtcgccacgtcagtcgtattggtcttagtgacgtcgcgtccgtccatgacggtatcattcattaccaccagcacgccgcggttggcagactgtttatcagccgctgttactaccgcattatagaggttgaacgggccatctgcgctcattgacgtggaaggacgcatcgcgccgaccagtaccaccggtttattgcatttcacggtcagatcgaggaaataagcggtctcttccatcgtatcagtaccgtgggtgatcacgaaaccgtcggtgctgtcgcactcggtattgatttttttcgccagcgtgagccagacttcatcgttcatatcctgcgagccaatgttaacgacctgctcgcctttcactaccgcaatgtccttcaattgaggaacggcatccaccagattttcgacgccgactttacctgccgtataatttgattttgttgctgaatcaccgccgccagcgatcgttccgccggtcgctaagatggtgatattcggtaaagcgaacgctgcgccgctgaaacccattaccagagcagctaatgccgttttcctgaaaaactccatgttatatctccagttatgtcaactggtcgcattatccctatattgcagacgaataatgtgacgccatacgattaaccagcgatatatatccgacagagagtattttttagagatggataacaaaatgcaggaaaaaacagaataaaaaggcgcagatacgatctgcgccattgttgtctatggaaaacccccagctaggctgggggttccggaaagcttttagctttaagtcagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttatttaaaaaggaaagattacttcaggctgccaaccagcgctttgcggctatcttctaaggtcactacgcggctacagacatctttgccaaactgctggaaatctttctcctggtttttccattcgttctggatagcggtttgcaaaccaccgagactacccatcacgccctgtaaaggattgccgccgcctttaagcaccgctttggcgcccatttcgttaatgctgtcctgcaaaataccgcccatcgcctgattcaccaactgctgaccgtcggcacgcacctggtcgatagccttatagtggaacgtcaggccgtccgtacgatgttcgataatgcggttcatttgcgcttttaattgcgcatcaagcttcgtcaggcggctgcgcatgttgctgctttcgcccacctctttagcgatgattttatccagcgccacgcggcctttttcgacgcgcgatcgggcgccctcatcaatccacggcagcgcgcttcgcagttccgcctggtaatctttcgcctgctcgcgctgcgcggcgctaagggtgtactgcttaccgttgtacatcacattgccgtccggcgtgatcaccaggttgccgttttcacctttcacctgcaccgtttgtggactcaggatcacatcgtcacgcggcgtgacgctgcatttgtaatctgcatgagcggccatcgccgtaaacgttagcactgccgccagcagcgttttgcgcatcataactttccctcaagacaaagcgggccggcatttgccgaccctgtacttattagtcccaccaaacgtcgaaaagttcgctggttcggacttcttcaaggttgcgcgcttccagccacttacgcacaatcgcctgatgttcttcggtacatttaccgatttcctgcatacaaatcagcccttcccaggccaggtagccgctgccgtcaaacgccagtttattaggctcaataacgtcattaataaagtcatcgacagtcttatcgatctgctcttcagatgtaccttccggaaaacgccatgccaccgaaaatcctaattcctggaattcgtcaatgtgcatttttttacgcagacgacgactacggttctttgccattatttcaccctctcgaacattaagtcccatacgccatgaccaagacgatggccacgttgttcaaatttcgttaccgggcgcgattccgggcgcggtacataatcattgctctctgacagatttttgtacccgtcgatagaagacatgacttcaagcatgtgttccgcatacgcttcccagtcggtcgccatatggaaaacgccgcccaatttcagcttgctcaataccagttcagcaaacggcacctgaacgatacggcgtttattatgacgcgctttatgccacgggtcagggaaaaagagctgaaccatcgataaagaattgtcaggaatcattttatgcaacacttctaccgcgtcgtggcacatgacgtgcaggttttcaacgccctcttcatgagcggacgccagacacgcgccgacaccgggtgaatgcacttcaatgccgaggaaattctgctccgggcgcgctttcgccatcgccacgagagacgcccccatgccaaaaccaatctccagcgtcaccggcgcttcgcgaccaaacaacgtggcgaaatctaccggcgcttcgctgaactcgacgcccatcaccggccagtagttttccagcgcgtgctcttgcccctttgtcagtcgcccctggcgacgaacaaaactacgaatacggcgcagcgggcgaccgttttcatcaaattccggtgaaatgacgtcgtttttcataaaagtgtagtctgctgtgtttgagttctgaaaacgggcattatccaaagttagttgccggatgcaagcatgaagcgcactgcggaaagttccggtttacaccctgcggcctctgtgctgcaatcttgcccccggcaataatgaatgagtttccatgcaagcgtctcaattttcagcccaggttctggactggtacgacaaatacgggcggaaaacgctgccctggcaaattaacaagacgccttacaaagtatggctctcggaagtcatgttgcaacaaacgcaggtgacgacggtgattccttactttgagcgatttatggcgcgctttccgacggtaacggatttagcgaatgcgccgctggatgaagtgctccatttatggaccgggctcggctattacgcccgcgcgcgtaatttgcataaagcggcgcaacaggtagcaacgcttcacggtggagaattcccgcaaacttttgccgaaatcgccgcgctccccggcgtcgggcgttcaaccgccggcgcgattctctccctcgcgttaggtaaacattatccgattcttgatggaaacgttaaacgtgtgctggctcgctgttatgctgttagcggctggcctggaaaaaaagaggtggagaatacgctgtggacgctgagcgagcaagtgacgcccgcacgcggcgtggagcgttttaatcaggcgatgatggatctgggcgcgatggtttgtacgcgttcaaagccaaagtgcaccctgtgtccgctgcaaaacggttgtatcgccgctgcgcatgaaagctggtcacgctatccgggcaagaaaccgaaacagacgttgccggagcggacgggttactttttattgttacagcataatcaggagattttcctggcgcagcgccctcccagcggtttatggggcggactctactgctttccgcagttcgccagcgaagatgaattacgtgaatggctggcgcaacggcatgttaacgctgataatttgacccagcttaacgcgtttcgccacacatttagccatttccacctggatattgtgcctatgtggcttcccgtgtcgtcactggacgcctgcatggatgaaggcggcgcgctctggtataacttagcgcaaccgccgtcagtcggactggcggcccccgtggagcgcttgttacagcagttacgtaccggagcgccagtttaacgccccggtcgatgaagaggatgacttatgagcagaacgattttttgtacttacctgcaacgcgacgctgaagggcaagattttcagctctaccctggcgaactaggaaaacgtatctataacgagatctctaaggacgcatgggcgcagtggcagcataagcagaccatgttgattaacgagaaaaagctcaacatgatgaacgccgagcaccgtaaactgctggaacaggagatggtgagcttcctgttcgaaggcaaagacgttcatatcgaaggttatacgccggaagataaaaaataggcccgttgctgaatgaggctgcgcttattcggcctgtgagttatgccggataagcccttagcgccgctgcccggcaacatggcataacgacaacacaacatgcactcccggaatgatgaaaaaattactcgcgcttgctgttattgcgccgttgctcatctcctgctccagttcgaccaaaaaaggcgagacgtataatgaagcctgggtcaaggataccaacggctttgatattttgatggggcaatttgccaacaatattgaaaatctgtggggatataaggaagtcctgatcgccgggccgaaagactacgtcaaatataccgatcagttccagacccgtagccacatcaactttgatgatgggaccattaccgttgaaaccatcgccgggacggaacctaccgcacatctgcgccgggccattattaaaacgttgctcatgggtgacgacccaacctccgtcgatctttactccgatgtcgatgacataaaaatttctaaagaacccttcctgtatggtcaggtcctcgacaataccggccagcctattcgctgggaaggccgcgccacgacattcgcggattacttgctgaaaacgcggctcaaaagccgcagtaacggcctgcgtattatttacagcgtcaccattaatctggtgccgaaccaccttgataaacgcgcgcataaatacattggcatggtacgccaggcctcccgtaaatacggcgttgacgagtcgctgattctggcgattatgcaaacggagtcctcgtttaacccgtatgcggtcagccacgcggatgcgctgggcctgatgcaggtagtgcaacacagcgccgggaaagatgttttccgttctcagggtaagtccggcacgccaagccgtaacttcctgttcgaccccgccagcaatatcgataccggcacagcgtatctggcgatgttgaataatgtctatctgagcggtatcgagaatccgacgtcgcggcgctatgcggtcattactgcctataatggcggcgcaggcagcgtattacgcatattctcgaacgataagattcaggccgcgaatatgattaaccgcatgtcgccgggggatgtgtaccagatattaaccacccgacatccatctgcggagtcgcgccgctatctgtataaggtgaattccgcccagcgatcgtatcgccgccgataaaccatcgcatcccgcctctggccagcaaatgacagaggcgggaaaggcaaaagtgttaactccgtcacccttttgctttgcaatcagaaattgtttgcaaatatttgtcacaggtaacaaaaaaagcccgcctctcattgatagaatcacaccaaatcacaacggcaaatgtgccttttaaaacattcatccgctctcaggtgtgaggaaattaacatgaatcttaagctgcagcttaaaatactctcttttctgcagttctgtctgtggggaagctggctcactaccctgggctcgtatatgttcgtcaccttaaaatttgacggcgcatctattggcgcagtttatagttcactggggattgctgccgtctttatgccgaccttgctaggcattgtggctgacaaatggctgagcgcgaaatgggtctatgccctgtgtcatgtcgtcggcgccatcacgctattcatggccgcggaagtcactacgcctggggcgatgttctttgtgatcctgcttaactcgttggcttatatgccgacgttgggcttgatcaatactatatcgtattaccgcctgcagtctgccggcatggatattgtgactgactttccgcctatccgtatctggggcaccatcggctttattctggcgatgtggggcgtgagtttctccggtttcgagctgagccatatgcagctttatatcggcgcgacgctttccgttctgctggtactgtttacctttaccctgccgcacattccggtggcgaaccaacagaaaaaccagagctggacatcaatgctgggccttgacgcttttgcgctgtttaaaaacaagcggatggcgattttcttcatcttctccatgatgctgggcgcggaactgcagatcaccaacatgtttggcaacaccttcctgcatagctttgataaagatccgctattcgccagtagctttatcgtgcagcacgcctcggtgatgatgtcgatttcgcagatttctgaaacgttattcatcctgaccattccgttcttcctgagccgttatggtattaagaacgttatgcttatcagtattgtggcgtggatgctgcgtttcggcctgttcgcttatggcgacccgacgccgttcggtaccgttctgctggtattgccgatgattgtgtacggctgcgccttcgacttcttcaacatttctggctcggtgtttgtcgaaaaagaagtacgcccggaaatccgcgccagcgcgcaggggatgttcctgatgatgaccaatggcttcggctgtatccttggcggcattgtgagcggtaaagtggtggagtattacactcaaaacggcattaccgactggcagaccgtgtggctcatcttcgcaggctactcgctggtgctggcctttgcgttcgtagccttgttcaaatacaaacacgttcgcgttccggcaagttcgcaacccgttgcacattaatccttgccctgtttcgcaggccggataaggcgtaaatgccttatccggcctgcaggcaacgttactttaaaacatatccatacaagcgtttaattccatcggcatcggtctcgctatataccccctgcaattccggcgaaaaaccgagcaacagattgatgccctcttccagcgccaaaaaataacgctgcgccgcgccaccccaaatctcccccggcaccacgcacagtacgcccggcgggtatggcaatgccccctcggcagcaatacgcccgcccgcctcgctgatacgcaccagctctacatcgccgcgaataaaggcgctgttggcatcctgcgggttcatcgccacatgcggcaggctttctttgcgaaacatcgctttttgcagatccttaacgtcaaagctaacgtacaggttgtgcatctcctgacatagctcacgcagggtgtaatcgcggtagcgcaccgggtatttctgaaaaaccgtcggcaatacatccgcaagcggcgtatcgtcttcaatgtgccgttcaaattgcgccagcatcgcgaccagtcgcgccagtttctcttcgctctcggcgggtgtcagcaagaatagaatcgagttgagatcgcacttctcaggcacaataccgttctcacgcagatagtgggcgagaatggtcgccgggatgccgaattcggtgtaccgcccactatcggcatcaatacctggcgtggtcagtaacagtttacaaggatcgacaaaatactggtcatccgcataaccctcaaagccatgccatttcgccccgggctcaaaactgaagaaacgacgattgctggcaatggtctccgtcggatatgcctgccacggcttgccgtcaaccaccagtgggataaagggctgaagcagtttgcaacgggcgagaatggctttacgcgcgtcaatgcccagcgcaacgcactccgcccacaggcggcgaccgctctccccttcgtggattttggcattgacatccagcgccgcaaacagcgggtagaacggactggttgaagcatgcaacatgaaggcgtttgtgcgggcaaaaacgcgcctggccgcgaatatggttatcttttttgtggatctgcgaggtttgtgagaaccccgcctgttgcttatgtaccgattgggtcacaaagatcccagggtcgttttcattaagctccagccgcaacggcgaggtatccgccatcatattgataaactgctcatagcctacccacgcggagtcaaacagaatgtaatcgcagagatgcccgattttatccaccacctgacgggcgttgtaaatagtgccgtcataggtacccagctgaatgatcgccaggcggaacggacgcggcgcatcggcgctttccggcatcacgtcacgaatctggtcgcgcaggtacgtttcatcaaaacagtgcgcatcaataccaccgataaaaccaaacgggttacgcgccgcctcaagatagaccggcgtcgccccggcctgaatcagggcgccgtggtggttggatttgtgattatttcgatcaaacagcaccagatcgccgcgcgtcagcaaggcgttggtgaccactttattcgccgccgaagttccattcagcacaaagtaggttttatccgcattaaacacttttgccgcaaatttctgcgcgtgtttggcagaaccttcatgtattagcagatcgccaagtttcacatcggcgttacacatatccgcacgaaacaggttttcaccaaaaaagtcataaaaatggcggcctgcgggatgttttctaaaaaactcgccatgctggtgccccgggcaagcaaaggtactattccccatgtcgacatactgggtcagggtgccataaaagggcggcagaagttccgcttcgtagcgacaggcagcgttttccagctccagccattcctgcgcgttcccgccgattaccgccgtaacgccgacaggcgcgctgacgggttcatccgcaagcataaataccggcaggtgaaaaccggtgcgtttaagcaacgccagaataccgctacggctgtcggcagtggtaatgacgactgcggccacatcggtaaagtcggtactttccagtgccactacgtttcggtgggtggagagacgggggatgagttcaccgctggcggcaatattcattgatttcataagcgcaaatacccgtttcgggagtagagtaaccccggacaaggccgatgccttgcccaacgagatgccgggtcaaactggataccagctccgaccgccagacatcagtaaaaacagactgtttctgattttactgttgtcctgcagtgagcgtgcgctgccctcaccgcatagcggggatgacaaaaaaaaggaaagaaaggggcaaacctcgcgcagtcaggcgacagtgaagacaatataaaggcgctatgttcatcccggcgagccccatgctggcaggagaaatttcgcgcaatcatggcacctttcaccagacggcgcaaggtaaaatcagcgctctatacgtcacagataatcaagctattaacagcttaatcgcgtgataataaggcaatttgaaagacaaataacaggagtcattgtggtaattggaccttttattaacgctggcgcaattttattcggcggcgttattggcgcgctgttaagtcagcgtctgccagaacggattcgcgtctcaatgacgtctatttttggtctgtgctctctgggtattggcattctgctggtgatgaagtgcgctaatcttccggtgatggtgctggcgacgctggtcggcgcgcttatcggcgagttttgtttgctggaaaaaggcattaatggcgcagtcgcgaaaatccaacaattatttatggcatcgggtaagaagccgacacacgactcttttattcaaagttacgtcgctatcattgtacttttttgcgccagcggcaccggtattttcggcgcgatgcatgaagggatgaccggcgatccaaacattttgatcgctaaatcttttctggatttttttactgccattattttcgcctgttcgcttggcatcgccgtttcggcgatttgcgcaccgatgttgattatccagttaacgcttgccgcctgcgccaccctcattcttccactgactacgccggcaatgatgggcgactttagcgccgtgggcgggctgctgctggtggcaaccggcttgcgtgtatgtggaatcaaaatgtttccggtagtgaatatgctcccggcgctgttgctggcgatgccgatctccgccgcatgggcgatgttttttgcctgactctgcgtgcaataacaacaaagtggtgatagattgtgcagtctacgttgatttgaagaaatttcgttgacgaagcgaggcgattacggtttaatgcgcctcgttgcccggatagctcagtcggtagagcaggggattgaaaatccccgtgtccttggttcgattccgagtccgggcaccacctttccttttttacacttccttataaatccccatgtgtttttaattcaatgagttagtggaaaaactcttcccagcgaatttctatttatccgcccaaatcaggggcttttggtggtcaactcggtgctcagttcggttagataaaggagtgccctcaaatggcattaaccgacaaacaagcacgtagtgcaaagccttctgataaaccctataaactcgttgatacactcggcctgtatcttctggtaaaacccaacgattttcgtatctggtatttcaaatatcgttttgagggaaaagagtccggggtatcattcggtccttatcccgaaacctcattcgcccttgtccgcgaaaaacgcgatgccacccggcgcgtactaaaatccggctttaccccttctcagcagcgccgggacgaaaaaaggttgtcaatgaattagaacgttccagtacatcgctagattgtggcataccggctgcctgaaactctggtcagaaagtcactccaataaaattcctgtctgcctccaacactacgttttccctgatatcggcgcaatgggtatttcggcgacttaaaccctacatctcgcacgactggtcagagacattgatgataaaggtgtgcatgttgttgccggacgtatacgccagcatctgaccaaaattatgcgccacgccgtacagcagggaacgattaaatataatccggcattcgatctggatggcgttgtaactcctgttataacccagcatcaccccgcccttcccctgaaacgcctgcctgaattgctgggctatatcgacacctacaacaaggccggataccggctatcaacactttccggtatgccgcactgccaggacaacaccaaacgtgagttcacacatctggttagagtttctctggcttaccgcaaaattgagtgggaacacgtttcaacaggcacttcaggtgctgatgactgacgtgcgccgctggaagcataagagtaaatccacagcattccgccttaatggtgggatgctgtttttgtccgggaacggagacaaaaagcccgtgccagcaatgagttacgtctgttacgtttcatatatgggagatggtggatgccggaaactttggcggtagcgtgcctgaagcggctgtcctccccattgccactgccacgagcgtaccgtggttcctttttcgccaataaatccagaataaggttatgtcacaaaatggcctgcgttttacgctggatgtggacggattaacgccggcggcaaccactgtcgtcagcttcaccctccagaggtatcaacagttcaacaggtgcaagctggaataagaatgaaagactaaaaacaccagatgatgcatccaatgatagcattaaatcaggccatggttcacaggaggaaatattaccatcttacctttacttaataagatcatttttaatgaaaataggtttatcaataaaacaaaaaatattcttgacagcgaaattgcatcttttcttgcatcttcaagtcaggaaggatttgatttagtggatgataacaataattatctttttgatcgcacagttaaaaaaattaggcgcattagctgataatgaaatgtttggtttggaacctgcatacatttttggcggggaaataaaaaagttttctttattcaaaaaattgaattttctgatggtaagattatcattgataatgaatctgtgtcatggtcactaaaaaatttagtacacaaacagaatactcatgctatatccaaattcatagaaaaaagaaagagaaactttatctaataacaaattttaaaaaaatcagcagtgcgttgagaaaaccaatacatacattcccagatggaattatgccatcaaatagaagagaaaataaattaattaatatcctgaattcgcataaaaaagattcagagtttagatttttattaaaagaattaattagttatattggagttacagtaagtacaatgttcctatcacttattaactcctaataaataattattcttattttccaggataatctcacaacttattatttagtaatgaagctatggagaaaaatgcccacagccgcccgactcaacgataaaggcacccagtacgacgattattacgagaccgtgagtatagcggattcccccacggtatttattgacggcctgtccgttgccagaatgggtgatgcggtggactgtggcgggatggttaatatgactcgaatgaaatcaggtaaggcatcaaaggttagaaaagttgacagagtcggaaaacaggggttcgagcttcatcatatagatgaagttgcaaatagaggcgatgtttacaatgtagacaatccccgtgtgaacaccatattgacatacacaggcgatttatgaaattaaaagaaaatattagtgattatacggaaagtgagttcattgatttcttgagagtgatattttctgaaaacgagtcggatacagatgaaacattagatccattacttgagtattttgagaagatcactgaatacccaggtggaacagatcttatctattatcctgaaacggaaagtgatggaacacctgagggtattctgaacataattaaagaatggagagaatctcaaggattgccttgttttaagaaaagtaaatgaaaatcaggtgtaggggaatgcccagagttactggcgcagtttagtaaatcgaatcaaactttgataaaaagaggtcgagcgccttactccttgataaggcaacaagtcggaggtaggtggacttatgaaattccccacgttggaaagatccagtatggaggaatggtgtttgatgttgataaccttatgataaacactcctaaaaatcatatacgattgcataagtaaggtttgaggtgaaaatggaactaaaaaataaccttgaagattatacagaagatgagtttatcgagtttttaaataatttttttgagcctcctgaagagttgactggagatgaattatcgaagtttattgataatcttctacgccattttaataaaattactcaacaccctgatggcggggatttgatattttatccatcagaggaacgagaagatagtcctgaaggagttattgaagagctaaaacgctggcggaagtctcagagactcccctgttttaaggaaaataagtagcgatcagtggtgaggagtttgtcaaccggaaccgggatgataatgcagtgaccgttaaaaggcaaaaatatgtcagttaagggagtaactatcaaaggcataattctgagtgtttttacactgaaccgtagtgccagaggatatatttatctgacgcgaatcgtatgaagtgatagctttacgtacggtttgtgagaggctgtagggaaagatcctacggcctactcactaagagtctatttttgtacattgtttcatgttctggaaacacgataaagtatgagcctgacgaactctcgcccgctaaagttccacgctggaacctgacggccaggagtcggacatctttgcggtggcgaatttacatccgttcaaaaaaatctaatgtaagagatagatgatatggctaaatatatattcctctttatctggattgtgacattttctgtcagcgctggtgagcgaggatattatttattcgtatggggtaaccctgaagggaaggaatattttaaagaatatagagctgatgaaaggatatatgcggtcaataaatcctgttggaatgaaagagcggggaactctatacgaatagtatatgttgatacttatcctcatggaataaccgattctttaattaattcctttttggctgggaataataaatccataataaatattagagtatcattgagtaattttagtgacgatcaaatacttcatggttttgatggcatgttaataataaataaaaaaaatgaagagatcgagatttttactattccagtagttggtgctaattactcatataaagataaatttttagtaaacgtccatgattttgaattatttgatggaaagatctgtaacgctttgatgcctatagatagttatttttcaccataagaagggttgttgaataaatcaaattaccctgtaccgtcaaatgtacctaccgtcgacacgggtaacggatctacatcttctgggaagcaaaaggcaacaacaaaagatgcggaacaattgccgacagagggaaataaaatcgtggagggcctatagctacgggctgagattatctgttcatgatatgtatggcacacacgttaccataacatcattgaatgtatcaaaaatgcctacgcagcaaacgggcattacaggatgcaggatcattttagtcttgacagtaatgatataacacattggctttatagccattgggatgtctttaaaatttggtttgtacttcaacattatgagaaagaggggtatgagtttaagccatttatacacaaaatcattctagatgcattgcggcggcaagggaagaaatccccgggagcatagataactctgtgaccggggtttctgagcgcagccaacaaagaggcagcttaaaggatgaagtgtatattacagaaataaataccaccgtaaaaatctcaggtgtcagaggatattactcctgatttggtatgtattgtcggcaaggtatttgtttgtattgttaacatagcatagtccgatattttgcataaggaatgtgattgtgtcatgggtaataacgaaaaaattcatttatattgtgacaatcgccatattattttgttctgttgttatatacttatggtcaggcagaccagtagaaatcgtggatgtccattattattcaggtaaagacattaacattcttgccaggcatttccccattacggacaggggaaagctgaattggtggagagaaaatgaaagaaaaattctggaaaaatataatctccctaaaaataatttttcggtatatatatgggattttggtgacggttatcaaaaattatcgccctatgatgccgaggatgaattttattgttttcctgatataaaatcagaatcaaaatgtatcaaaaaagatatatatatgcctgctgaatctggtggtaattattatcggatgtttttattttctggttctggttatttttatcaaccgaaaaaagatgatgataagcttatcgaatcaaataactccaccaagctcaaccaggataaaagccatgaaaaaaatcactatcattagtttgtttcttatcttacctttgaaagcaaatattattccatctatatcattaccagataaattaagtgagtcgaaatattctgtaagaatgcttcgcattgatgcaaggattgactatcgcgtggaaacccctgagtgtaagaacgtaaaatttaatgattactttttcttaaatgaaaatattaaagatctcaatgataaaaaccatgtttatgatcctgagttttatccaattacattatggagttgttcatatagcagagaggtgtatgatgttggtgagtatggctcacatatacagcacatcgtttttgataaaaataaaaacatatgggtgatagatgatgatgcaacaaaaacaaataatgaatttaaaccatcatttttatataatataagttcagtgaatgcacagggtttcttaatcattgatgagaatatttcggagatggataaaacaatatacgaagatgataacataaaaaagaaattttatttttgtatgattgatggctcacatgctttatgcggcgcaggcagtttaatcagaaaaatagataatcagttgattgattttacgccatacatattaaagtcactggaaagtatggagattggcgttaattaaaaaagaatatccgatattaatatactctaaataatttgagttacaggaatgcagtaaatttccaggagtctggatgttggatactgagatgagcgtatcattaatgacgaggttactctgcgttatttaagtggttcatgccgctttagttctgtctttgacacagacgagtggcttaaaactccaggtgagagcaattatcatttttctgttccacttgataatatgtatcatttttatcaggtcagcatcgttatagtatacgtatagtggattatttaatcgttgatagaaattagctttcaaaacaagaaatttactatcatgcgctacgcctgttgacgtttacgcctaataagatatgccagaaaacagataatggcagggttattcttcagcataaaattaactgtcataataatggtgatggcgacacataaagaaaaaccatgaaatataatgaaggcacgtttaaatatatgctcaaaaaaatcattggcgctctcgcgtcaattattggcgggctacttgcttttttatgtgtctattggttatttcgtctggatacctggacagaacgaggggtttatataggcatctctatatttttggctcttattctcataaaaatactatcatttttcaatgatgaatagacggcaggaaaaaccgtgagtgtctcacaccgattcttgctggatgtcaaatttcgaaagcctgccctgctgataccctatcaagaagaaactaacccaacaattatcagacagtagcaggaatcgaacccacaccaggcaaatcacgtagataattctgtaagggttagttttgtggtggtcttgataaacggtaaaaaatagctttaacagtccattagcccaaaggacttctccgagtccgggctccaaccattcagatgcggacgccctatggcgtccgtttttatttataaaatcaacaggttaccccgcccttcatgttcactactgttcattaaaatatactggcagccaccgctttttgtgggtaaaaacgccggttttctgcatagcgcatgacgctattgaaacgttatttagcaaatcctgtctgagccagaaattaagtctctgttaacctgcgctattacagaaaatcatagaacagtcgtctcaaaagaatatcgtcctgaaggacgagaactcacggcattttcaggagatgagtcaaccgcgacagaaaaaaatcatattaataattttaaattattttttataaaaccagacaggatttaaattaaaatcatttattttcaagatgttataaaaaataccgcaacatacgtcacattattaacatgtgaatgattgtgttaaccgaatgtaaattgtatgtttcaacataccactattttactgcgccccgacgcgctcatccggatggaaggagataacatgtcagccttatcaactactggccataatgacgggatcactctccattgcttacagagcattgcgcaactcattcctctgtcgtcggcggttttttatcgtgttaatgcttatttaaagccggaagcctatgttttacataatatttctaatagcacacaccaacaatatctggagcattttcaaccattagacccgctattgccttcccgattcggccaacaggttattacagtagcgacgatgacgcccggcatctgtgctcgtcatcgccattattatcatgaatttatgctacctaatcatgtgtgcgacatgattgagatctttattcgtcggggccatcgtattatcgcgggcatttcattaatgcgcgatatacctttttccagcgaagagcgtttgcgagcccaggcagtacaaccattattgggactggcaattcatgattctcttcaggaagacaacgatctggcgtcaatattgaccgccaaagagcgtgaaattgtgggaatggtctgcgaaggggccagcaacaaattgattgcccgtcagttgaatatttctctctcaacagtgaaaacgcatttacgtaatatttttgctaaaacagaagtgataaatcgcacggaactggtttcccgaaccagaatgtcctcggtacaacattcactgaatatgtgaaagcgttctttttaacccgcgtcaattgcgggtcttttccccatatgtcatatatgcctgaattaataccaccctctgagctgatgccgcaataaaatgtcatattatctggcgtcggcatcctgttgcagccattgattcatggcctgattgatcatatttatcacactaagcagaagaacacgctggtgccgctcaagccgcagataacggcgcagcggcggcattttacaaaccacttcgctagcagcccatagctcaatgctgcaataccattccttatgatgtaaaaccagagtaaaccgacgataatccagttcactcagagcctgttgtaaattggggaaacgattaagatagctaatcagcccggcggtacttttactgccagtaaaaatgacgggataacgtttcagccatccgggctgatgagcgcgaattttgccctgcaaaggataattgattgtgcctttcaccctgaattcacaactgtgaatactggccatgaataaccgtttttgctgaacatggcagataacctgggtaaatgcattcagatgcagcacggcgctatgttcggtcaatttttcacaacgccagccgctcaaatcacgtaacaccatattcattaatgcgttcttaaaccaggggacggaggacatctggcgtcatctcttcattgtttcgcttttcataattgcccatcgcccgttccacgacctcttctaccggaagcgggaggaaaggattaacccgttgcacacataatgtccagaataaggcataggcggcagtcaatccaagcataataccgaatggtataagtacatcccgactgttcattcctggaggcgcgatattaataatggcgataataatacccacgctcgaaataatctgaggtaagggaaaccagggggcccggtaagcgcgtggtaaatcggggcgccgaatacgtaagataacgaccgataacgttaccagcagataagctactccccaggcgcagaccgcagcgaggatcagcggaacaatgtggtcgatatcaccgttcagataccaggcatgtaaacagggaatcgcaacaccgaatgcgatggcgatgaccggtgttttaaagcgggggtgcaaccaggtcagaaaccgcggcaaagcgccgtccagcgccatgccgtatataatacgcggtactgccgccattagcgtattaatcgtcgcacatcccgctaacaacaaccccacgcccagccagtattgcccgacatgtcccatgacacgattggcaaaggcgggaatagccatcggcgtatccagtaaaaagatatggtttgccgcatcgaccaccacattatttacctgccggttaatcgcagcgccatagaggaacatacaacctgccaccgctaaaaggccaagcgccatcgctctgggaatcgtacgatgcgcttttttaatttccggcgccattggcgtgaccagttcacaaccgacgaacataaacatcgccatgcctatataaccaaacagaccagaaagattactgacatcaagcggtgcgccaaaccacccggaatgatgagtgaccggggataacaggatcccgcataaaccgaagatggtcagggtagtccacataccgaatgtaagaaacacttccaccttgccaaatacttcaacaccaatggcattcagtatcccgaaaaccactaccatgccgacgccaaccatccaggtattgtgctgcatggccacgtgttcgctaacggactcaaagttcaccagcgccatgacgccagcgagaatcgtttctgccgtgccggcaaaaatgtgtacgatcaggtaagcgcaaagcgcaccggtgatagcgaaaaaacgccccatcccgcaggagatatagtcgtagacggagccagtcgtgggaatgagcgttgccgcttcggcaaaggtggtaatctgcgcttgcatcataataaatgccagtaataccgcaagggcaaaggtatctccccctgagccaaaaccactggtcacggtcaggatcaccgggcttgccataatcagcccgacggagctggcaagcgtcgtggggaaaccaataacgccacgttcaagatggctggcaagtctgtttttaaacatggtcaacctcttcactattattacaacaataaattaccgctccggaataacgcttatttatggcaggcagcgcatctaacaggtatcgtcctgaagagggataacggtaaataacgttgtgacgccgtccccgcatgcgctaatagcaagtggggagcgcgttattctccccagtgatgccaacgctactgacgaacaattaaagggttcaaccctgtttatggctttcaacgtttgccagataatgttttacaaaacggggcgttaaaactttccatgccacttcggttccctgttcaacaaaccaactatcgcccggtgaaaaacgtatcggttcctgacccacaacagtgagttccacttccccttccagcacggttgcgtgctcggtaaagggataaatcatagtgaaaccgccgcgggtcgatgaaaacagtccacaggtaaatacgtcctcaggtttaccgtaaatcatcgcaacggcgacctggggacgccttctgttggcaacgcccctaacaggctgacactcccgactggctgtaattcaggaacaggttgattgagtttaaaagcgtgcattaatgttctcctggttaattccggcctttccagaaaccggctgtttgatgtatcagttttcccgcactgaccagcaatagacgtagactgtcgcgaccataaattgtcgcgtggggaatgctactcatcagacgataccgctcggaaccgccatttattccttcggccaggattttgcatacaatatgggaaggcgtgacgccaaatccggaataaccctgaacataaaaaacattattgtgctcacgaagcgtgccaatctgcggaaacagattcgcgctacaggccatcggtccgccccaggcaaaatcgattttaacgtctttcaaataaggaaagacctccgtcaacagagtgcggttccaggcagcaaaatcgtgcggggtatattcaagaaaccttgtggcgctgccaaacagcagacggttttcttttgtgagacggtagtaatttatcaccgggcggatatcgctaaaagccccgcgcaagggactgatccgctcaacaagctcgctggagagaggttctgtagagacctgataagaataagtaaccagcgttttcttataaatttctggttccagattattgagaaaactatcacaggcccacagcaatttggctgcttttacgctgcccatcgcagtacgtacccgcacagttttaccgtaactgacctcaaccacaggtgaatattcgaatatcttcacccccagcgaattcgcagcctgagcggagcccagcaataaattcagcgagtggacatgccctccccccatatgcttgagaacaccgcagtagacgtcggaaccgataacctgctgcacgtctttaccggtatagagttcaatatcgtcttccggcgtagcggctttgaattctttttcccattgttgcagcgtttttaactgccgctggttgtaggccagataaccatatccggggacaaaatcagcatcaatatggtatttacgaattcgctcccgaataatacccgcgccgaggttcgagattttaaacagcgtctccattcccgctgcgcctacatattttttaacggcttcgatgtcgtgacctataccggccatcacctgaccgccgtttcgcccggtgccgccatacccaagatggcgggcttccagaacgacaacattagtgatcccctgctccgccagttccagcgcggtattgatgcctgaaaagccaccgccaatgatcaccacatcggcatcaatatcgtcttgcagagcaggaaaatgcaacgggtattttttcgtcgcgccgtagtaattcaacgcatcgatttttgtattcatcgcgttaccttgtcatcacgcttgaccaagaccgctatcacagcacggtaacgttttacaaaatatcgtccggaagaatgacgttctttggaacgatattcagttccaggcaagtatgttgagatggaaaaacgtacattcctgacctacaggcacttctgatgagcgacgtgacattacttgccgaagtaacgacttttttacgccaacgacacggacaatttattgcaggtgaacgtcaggccggaaacggcacgaacttctcggtcactaacccagccaccggcaaaatcatcgccgacgttgtgtcgacaacccctgcgcaggcaaaagaggccatgcagagcgccagacgggcgtttgatgtctggcgtaaaatgccaacgttacaacgcggcgcattactgctgaaactggctgatactcttgccgctcatcgtgaagagttagctcaactggaaagcgtctgttcaggtaaaacgattatgctgtcgcgcggtcttgaactcgatcagtcagtggccttcctgcgttactttgccggttgggcaggaaaaataaccggtgaaacgctgaatgtctccctgccatcaatgggagaagagagatacacagcgtttacccaacgccaacccattggcgtggtcgtcggtattgtgccgtggaatttctcaattatgattgctatctggaagctggccgcagcgctggtatgtggctgcaccatcgtcattaaaccaagtgaatataccccgctgacactgctgcgagtcgctgaactggctaaagaggctggtttccctgatggcgtaattaacgtggtaaacggtgctggcggtgagatagcgcaacagctgatcgcgcatccagattgcgccaaagtgagtttcaccgggtcagtcgcgacaggtgagaaagtccggcgttcggcaacgtcgtcaggaaaacgcgttaccctcgaactgggagggaaaaatgcggcgctgtttctcaatgatctcacggcacaagccatggtcaacggtattcttgaagccggttatctgaatcaaggacagatttgtgctgccgcagagcgtttttatctgccccaggaaaaactggatacggtcatgacgctcctcagacaacggttatcggagatcgtgcccggctcgcctttagatgaaaaaacggtgatgggcccgctggcgaatcaggttcagcttgaaaaagtgctgcgtctgattcaacgtgcacgggaagaaggggataccattgtttacggcggtgaaactttacccggcgaagggtactttttacagccgacagcggtaaaagtgcgtagtaaaaacagtacgctgatgcacgaggagacctttggccctgtctgtagctttatcggttatcagaatgaaaaagaggcgctttcgcatatcaacgattcgccattcggccttgctgcaagtgtgtggtcggaaaatatatctaaggcattacgctacgctgaagatattgatgctggcatggtgtgggtcaatatgcataccttcctcgatcccgcggtaccctttggagggatgaaaggatcgggcattggtcgtgaatttggcagcgcgtttattgatgactataccgaacttaaatcggtcatggtccgttattaaccatcctgaaaatgatgcaggcagatcaaccataccgaaaggaggactgtctgcctgattatcaggttcgctcgctgcgtttttttgcttttgggataatgttaaacgcccggcccggcgttccttcctgcattactagcgccatctaccgttagagtaggctatctccagtcttaacggttcagactcatcctgtaacatcgcttccaaagacaacgccagcgtctgatgataggcatcttttacactgactttcagcatgttgatgctcggttcataacgtaaaatagcagcgcgaagctcacggcaaaaccagttgagaacccgtttgtcacccacattcacctcgtgccattccggcataccccgagtgagcagcggcggtaatgtctcgccacctggcacggcgcaagagttgaataaacatattaatttgcggcgtaccaattcatgtgggcttatcccctcaaccaagagcctgtcgaatagcgcgaccggaatggttggcgtcatcatcatttccctatctggtccatcgccagatcccatactgacgctctggactcctgttgagcgccgtctgatttctcggcagtgatttgccatttgattttcgtgaagttcagcgacatcgtttccaccggcttaccgccggcgccgccgctaacactgagttgtgatatcagcacgtttgtcagggtataaacgataagcgaccgcattttgccgtcgtcattgcggcacaacgtcagcaccgcggttctaattagcctcccgctacagcagtactcattgagcacaggcgtggcgaggtcgacaaatttggtgagcgacatttcaccaacatgcgcacgcccggaagtccgctcagtgaggctaacatcgttatttacctgcattgccacattgtggctataagacatgatctctatctgatcttcaaagccttcaacctggctttcgcctttgatattgtcgagctttaaaaaaatcgcatccatgatttatctccttgttgatcaggtggcagttcagcagccagacgaataccggcggccaacgcttgtgactcttattaaaagcgcaacgaccaaaaaacacagcgtgaaaagcgccaggtttgcagggattttgccaacgtttacccacgtctgatgaacgttattccgctggttgcaatgcaatagagggttttggcccgctgtggccaaatacaattgaggttatactgaacgctctctgccatattcaatcccttttatcgcaaagtatccctggtgccggtatcacagcgtcgttattcaaaaattgacatttcagaataataatcagctatatataaaaaacacatcaagaagcaaatatcaacttaatttttacttatttaataaaaaaaatccaaattgatttacatcaattaacacatacaaaagcattaaaaatcaaagcattaaataaaaataatcactatggaaaattttatttttcttaatactcacattataaattttatttgcttattttcctgtgaacacaaaaaatgatttaaatcaaaaaacaaactattctcgttgattaacgttttgaccgaaataaaaaagattttatacgtcccgggatagtctccctttctgatggacaatatgcattaacaagcgggcaaacaggtaacttctgcccgggtaatccgttacccgactgatattaacattgtcatgaggtgatatcatttgcctggccagccataatcatccggaaccggcgctacgccacgaacatcaggacggagcattttttgtcgatcctcttcgtcatccacccagacactggctatctcttcacaggttgcaaaccatacgccatcatgccctttaatatgttcaatcaaacgtgacaacatcatcatatgatgcccatgaccgattatctgcggatgaagagccatcgcatataaaccgttttcctgatggttataagcataggtaaaaatatccttccagcgtcgcagaacaccgtcagtatcgctcatcccctcctggttaccggtatacgccagtgcgggaaaatcatccagataccagctaacaggaatttccagaatcgcgctggccgggcctgcgatatttcccgtttcccaattcacctgccaacgttgaggatggtaaggcacaagatctctcgccatcaggctactgtcatagagaaaaccggcttcctccagaagatccagcgtattctcgctataatcccaatagggagaacggtatcccacagggcgtatgccaaaatgtcttttataacaggcgaacgccagatccataagtcggcgttctgtatcacgattcaccagcgtcgggttttcatgatagtagccatggtgagcgatttcatgcccggcatcaaaaatcgctttactgatttccgggaaggtgtctacagtgtgtccgggaataaaaaaggtggttttgatattattttctttgaacaatttcagaagccttggaacgccaacttgtgcgccaaactctcctcgtgacataaaggatggcgacggtcgattaaatccgcccagccataaagactgagcatctacatcgacaccaagattgaccgcaatccttttaccctcaggtaattttaaatatcccataacgacctccagctaatacatagaagggacacattctgttatttaatgtgtgatggccagatattatatatgcctgcttttctgcgtctgtccttgaacgttgttgctgcccccccaagtctattttcatatagaacatcgaggttaatttctcctgaaatgacatcctcttgattgacgtgcgcctctgcgataataccttgtggatttttccacacgacatcacaggggcttaaaattgaacttcgggcccagcagcctggcagtggcccgcccgggtttcctcccaggcaacagtgaacaagataaatttgattttcaatacaacgtgcgtggcaacaatgcctgactcgccaaaatccctgttcagtaaacgtagcggaaggcgttaaaattaactcagcaccctgttccgccagcgtcgcagcacactccggtatttctgcttcataacaaatattaaaacccacctttgcaaatggcagttgaaaaacagccattttatcgccttcctgagtataccaaccccgttcagccgggaagatatgcgtcttactgtgagcataatgttcgccatcgggtccccatatatgcgcaacattctcatagcgatctgctccagtctgctccagatgagagccagcaataatgaactgtcctctttctttcgcttcctgttgaaaaagctgcttataggcatccgtaaactgatcaattaaagttaggtgtgaaatgggtctttcttgccattttttcaatagtgtaaatagctcaatggtaaatagctccgggaagataacggcatcagccccctgacttttattaagaagtatccttacctttgttatgaaatcttcaaaagtgtttatttcagtaacaatacctttgttatgaaatcttcaaaagtgtttatttcagtaacaatatactgacaggctgaaacagtaaaattacgtgacatcgtgatatccccagcatgaaatttaaacttaaattaacgtatagcgcatggagaatattagggagtggacattacgacatcaggttattttttgtgaagctgcgcaaaatatatggagaaaagagtagaagcattgaacctttatttacataaaggggactttatcgatgatcgcagcgagacagagagtcgataaaaatccaggcgaaaaacaataacccttaccacaatattattttcagcatctgaaaataatcaggcaaactaaatgataacgcgctggtataaaaccaacgcgtatttttaccgataagggtaatgaagacggccacccgaaggtggccgttagaacccggtagcgcttcgcttatcaggcctgtgaaaccgagacagctttagcggtgagacgccagcggctgttccgtcattggcgggtggtgcttttccggatctttaatcagtacccacaggatgatggcgccgataatatcgaacagactgagtgcaatgaagaacgggccgtaaccgataatagcgaccaatgcccccataaacaggttgaagcttaactgtcccatccatgccgcagatcctgccagaccggcaaccgtcgcgacctcatttttcttgaacaggtcagcgctcatggtaatcacaacggtagacagcgtctggtgcgcaaaaccgccaatactcatcaatgcaatggcgacatacgggttagtcgtaatgctgacaaaaccgatcgaaatcatcaaaacagcgccgatggtaaagctacaacgacgcgcattgatcgtggtcatgtgcatcttttccatgaagaacttcgccaggaaaccgcctgcaacgcagccgaagtccgccgccaggaacggcagccaggcaaacatggcgatctcttttaacggcagatgcatcacgttaatcagatacagcggcatccagaaactcagcgttccccatgccgggtcagcaagaaaacgggtaatcgccaacgcccagaagttacgctttttaacgatctctttaacggccggttttttattatcgtcctggagatagctttcctggccgtcttcgatataacgcagctctttgtgggtgatccacgggtgtttatttggcgagttataaatcaggaaccaggtgatggcgaacagcacgccgatcccaccggtaatcacaaacgccatttcagtaccgatgccgctatcagcaaaggtcagcatcgcccagaccaccagcggcggcgccagcatcgcgccaattgaagtaccgatattaaacaggccccccgcaataccacgttctttcgtcgggaaccattcggcgctggctttaatcccggccggaatcgctgacgcttcggttagccccatcagaccacgcagaaatgccaggcttatccagccgccggccagcgcgtgcgccatgttgatcagcgaccacaacaaggcaaagataaagaagccgattttcagtccgatgacatccatcaaatagccggtgatcggctgcgcaatggtgtaacaaagctggaaggcgctcaccacccaggaatattgttgctcatcaaaatggagttctttcatcatcgctggcgccgcaacgctaagcgagctacgggacaggtagtttacgatggtccccacgcagaccaggccgataatccaccatcttaattttgtcatcttcatgataaagcctcgttaaaaaacattagctccgcgccgtctgacctgtagcgggaaaactgaaattacaaaaattggttgaccaatcaatattttctcatccggaccggtcaaaatctggcggcaactcccgcccttaatattcttgaaataaatacatcaactcatttcaagttgaatggtgaatgcttttcacccagcaaaaattgacgcagatcaaataaataaaattggcagaccgtgaatgatgatatttgtgatttggctagccaatttagataataaggttgacatgagaaaaattttggttgaatttagggggcagaacgggtttacaaagcacgtttcgatgttggctggcaatgggtcaaccacgaagacgttatcgcaagaagaggaaacgagatatgaaacaaacctggcgctggtacggacctaacgacccggtaacgctgtcagatgtacgccaggctggcgcaaccggcgtggtaacggcgttacaccatattccgaatggagaaatttggtcggtagacgagatccagaaacgtaaagcaatcgttgaagaggcgggtctggagtggtctgtggtagagagcgtacctatccacgaagacatcaaaacccacaccggtcagtacgatttatggatcaaaaactaccagcaaacgctgcgtaacctggcgcaatgcggtatctatacggtttgctataactttatgccggtgctggactggacacgtacggatctggaatacgtattgccggatggttcaaaagcgctgcgttttgaccagattgaattcgccgcgttcgaactgcacatcctgaagcgtccgggagcagaagccgactatacggcagaagagattgctcaggcagagcggcgtttcgccaccatgagcgaggaagacaaagcacgtctgacccgcaacattattgccggtttacctggcgcggaagaaggctatacgctggatcagttccgtcaacacctggcgacgtataaagatatcgataaagcaaaactgcgtgaacattttgcctatttcctgaaagccattattccggttgccgacgaggttggcgtgcgtatggccgttcaccctgacgatccgccgcgccctattctcggcctgccgcgcattgtctctaccattgaagacatgcaatggatggttgaaaccgttaatagcatggcgaacggcttcaccatgtgtaccggatcttacggcgtgcgcgccgacaacgatctggttgatatgatcaagcaatttggtccgcgcatctactttacgcatctgcgctctacgctgcgcgaagagaatccaaagaccttccacgaggccgcccatttgcacggcgatgtggatatgtatgaagtcgttaaagcgattgtggaagaagagcaccgtcgtaaagccgaaggtagcgacgatctgatcccaatgcgcccggaccacggtcatcagatgctggacgatctgaagaagaaaacgaatccgggttattccgccattggccgtctgaaagggcttgcggaagtccgcggcgtcgaactggctatccagcgcgctttctttagcaaataaccttctttcgcatggcgcgacgcgtcatgcgatttcccctactcaatgcaatagcaacatgcctcgccccggagatcgcgggcgaagacgtcgaatgacaggagtttgcaatggaacagaatatcgccaccgcccaggtttccgtcgcccgcccaaactgggacaaatcacgtctggtatcccgtattgtgcatctgggctgcggggcgtttcaccgcgcgcaccaggcgctctttacccatcatctactggaaaagagcgacagcgactggggcatttgtgaagtgaacctgatgccgggtaacgacgcgcggctgatcgcgaacctgaaagcgcaaaatctgctgtacaccgttgcagaacgcggcgcagaaagcaccgaactgaaaattatcggttcaatgaaagaagcgctacaccctgaattcgacggtcatgcagggattctggcggcaatggcgcgcccggaaaccgccatcgtctccttaaccgtaaccgaaaaaggctactgcaccgaccccgccagcggcgagcttgatgtcaataacccgctgatccaaaacgatcttgcccatccacagcagcctaaatccgccattggctatattgtcgaagcgctaaacatgcgccgggagcaaggactgaaagcttttaccgtgctgtcgtgcgataacgtgcgcgagaatggtcacgtcgcgaaggctgccgtcctcggcctggcaaaagctcgcgatgccgccctcgccgcatggattgccgacaatgtgaccttcccctgcaccatggttgaccgcattgttccggcagcgaccgaagagacgctacaactggttgccgaccagttgggcgtttatgatccttgcgctatcgcctgcgaacccttccgccagtgggtcatcgaagataactttgtgaatggtcgcccggactgggataccgtcggcgcgcaattcgttgcagatgtcgtaccgtttgagatgatgaagctgcgtatgcttaacggcagtcactctttcctcgcctatctgggttatctcggcgggtatgacactatcgccgatactatgactaacccggcttaccgtcgcgcggcgctggcgctgatgcttgatgaacaagcgccgacgttgtcaatgccggaaggcaccgatctggaagggtatgcgaatttgttgattgcgcgtttcactaacccctcgttgaaacaccgcacctggcagatcgcgatggatggcagtcagaaactgccgcagcgtctgttggacccggtacgtctgcacttgcaacagggcgatgactatcgccgcctgacgctgggcgtcgccggatggatgcgttatgtcggcggtgtcgatgagcaaggtaaaaccattgatgtcgtcgatccgctgcttgcacagtatcaggcgattcatcagcaatatcagacgccggaagaacgcgttcgcgggctactggccatcgagtctatctttggcaacgacctgccgaagaaccacgaatttgtgcaagccgttaccgacgcttaccaacagctattgcagaatggcgcgaaagccacggtagaagcgctggctaagtaaggagataaatcatggctacgtttatgactgaagattttctacttaaaaacgacattgcccgcacgctgtaccataaatacgccgcgcccatgccgatttatgacttccactgccatttaagtccgcaggaaatcgccgacgatcgccgtttcgataacctcggtcagatctggctggaaggcgaccactataaatggcgagcgctacgaagcgcaggcgtggatgagtcgctgatcaccggcaaagagaccagcgattatgaaaaatatatggcctgggccaataccgttccaaaaacgctgggcaatccgctgtatcactggacgcaccttgaactacgccgtccatttggcattacaggtacgctgttcggaccggataccgcggaaagtatctggacgcagtgtaatgagaaactggcgacgccggccttttccgcgcgcggtattatgcagcagatgaatgtgcggatggtcggaaccaccgacgaccctatagattctctggaatatcaccaccagatagccgccgacgacagcattgatattgaagtcgcgccaagctggcgccccgacaaagttttcaaaatcgaactggacggctttgtcgattacctggggaaactggaagcggcggcagatgtcagcattacccgtttcgacgatttacgtcaggcgctcactcgccgcctcgaccatttcgccgcctgcggctgccgcgcgtccgatcatggcattgaaacgctgcgatttgcgccggtgcccgacgacgcgcagcttgacgccattctgggcaaacgtctggcaggcgaaacgttgagcgaacttgagatcgcccagtttaccacggcggtgctggtctggctgggccgtcagtacgccgcgcgcggctgggtgatgcagctacatattggcgcgatccgtaacaataatacccgtatgttccgcctgctcgggccggataccggctttgactctattggcgataataacattagctgggcgctctcccgtttgctcgacagtatggatgtgaccaatgaactgcccaagactatcctctattgcctgaacccacgtgataacgaagtcctggcgaccatgatcggtaacttccaggggccgggaattgccggaaaagtgcagtttggttccggctggtggtttaacgatcagaaagacgggatgctgcgccaactggagcaactgtcgcaaatgggactgttaagtcagtttgtcgggatgctgaccgactcccgcagtttcctttcttatacgcgacatgaatatttccggcgtattctctgtaacctgctgggacagtgggcgcaggacggagagattcctgatgatgaagcgatgttaagccgtatggttcaggatatctgcttcaataatgcccagcgttatttcacgattaaataatcgctattaatctgtgagcacaggtttcaggtatttcgaggggcaggaaggcggtaagagagtgagaaatttagcagtaacgcacttttccagccaaagtctggccaccgataaaaagcaaagaggttgctgattaatcccgaatcacttactaaggtaagtgattcgggtaaacaaacacagccatcttctgcgtcatgctttttttctctgtccggaataactccagtgcagaaagtgtgatacatcagtcctgttgatgatggctcctgttggttatacggtaataactcatgacttcacactgtggtttcttttaacaaatcgacagccagcatttccagctggttaaccacctcattactggatcgctccattctgtcgagttcttgcgacatcgcattcatatcgcctgcggcaaaatagttcagcgcagagtgaccagcggtatgcacctctttatgcggcgcttccagactacggaaactgtagtaattgctaaactgctgcccttcaaaaccgtagtaccatttccccagccgacactgatcgtgcatcgttattttactgtttatgtctttatttaagagtaatttgtagacttccattttccagataacatggtcaactttgacaatattcaaaaactgcaccgtagagatgtactgcatgaccgatttcatgctcagcgatttatcaatgacgatgccaatagactccacaatttgatttatgttagtcgtaatattatcaataaccggctgttggttatccagcacctcactcactctggccgtattatctttgattacagaggttaacgtactgacgcttttcgaactgtgtttaacatcttcggacaggtttttcacttctttcgaaataacgctaaaaccacgcccggcatcccctacgcgcgcggcctcgatcgcggagttaatcgctatcaaattggtctggttagcgatcttctgtatctctttaatacacgcattaatttgcgttaaggaggtatttaagtcgcccatacgacagccaatatctgatgaagtcgtgccaatttcggtgataaattccacgagcgattttaatgaacttctggctttatcattctgttcgttaagttcattaatgcgttctttttcaatattgagctgctcacaggacttaatgatggcattacgaatgatatcgatcgtcgagatccccatcagaattttttgacacagtatccgctcataaggctcaggagtatccaccaccacgtcagacgcattagcgccagattctgctggcggcggtatttttacaacattattattccagtggcgcaagcctaatacttttttaaacatataccattctccttattatatgtggacatcctgatctatgcctggataaagtattatcaactcatgctaacataatgaaaaatcggctgtcatctgccataaccatacgttcaccagaataagacaaaatgtccactaaacttaaataattacagagtaaactattcaataataccattaatagtcataatggaagtcgcttcactttatacgaaaatatcattcacaaggctgacaataatagttgaataataattaactgcatttacttaggtgtatctatatctcgttccgaagattgcagacagggtttaaacgcaaacttttgcgatagaaaaataacctaacgtaaactttttatatgactaataatgtcatttgaactcgtcaatatattatgctgtccgtttaccagccaaacaggcatgaccgaaatccaaagggataggggcggcgtaaccagccgcaaaaagtaccgattagacgaaaatcaggaaacgagtgcgccaacgcagcgagcgtcaccgcctgcgttagaaaagttaagaataatttgtgatattatttctcatatgttaccagtaaatggcaagctgacagccgttcgttggtaaacacaacaggcgggatatcggcgccaacgccgatatcccgacgagaatgaccccgttacgctttgatgacgattaacggttcaatatcgctctcttttttaatgactaatgaatcatcgccgcgcaggcacgtaccgccgtagttaccgcccacggtaaacgtacagacctgaatatacttcccggcgaccttcggcaggcaccacaactgctgatagatatttttctgcgtggcgaacttgccgctggttttatccaggagttcttcctgatggctcaccaaatcaatattactaccgcaacgtccggcaatcggttttaccgcatagccggtctgcaccagctcatcgttaacggtaaaatccgtgtcgagcaaatagcgatgatgtgggaagagcgaccacaggatgggcaggatcgctttgttacccgggatcaccgtccacagcggttcaaacaccaacacttccgggcgcagtaatacatcaatcagccggacttcattttccgggtgcccggtacgaataggcactgcggcatactccgtctcgctgacttcgcgtatctgctccattgccgtttcccacgcccaggttttccagacacaattcaccagccgtccgtcgccatcgatcaactgcccggcgtcatcccagcgcaactcgcccagcccgcggagaattttgctcgcgaaaccggcctgatgcagcgcctgctgcataaactgcgcgtgatagtcctcctcgatatcatcatcctgcatgatatggacgaaaggacgcgctttactgtgtttccaggcgcctgccagctcgttaattaagccctccgccgggttatgccctttaccggtatagccctgctcagcccatttttcgagaattaatcccgcttcggtatggcatgatgcggaatcggcattgtattcatagactttcagcccgcgttcatccatgcagaaatccatacgaccggtgatcatatggtgacgacggcgctgccaggagagacgcaggcgcggccaaagaattttggggatatcgaatagcgccagcagattatcgtcttttaaaactttgtccgtggcgtgcaggtacatcaaatgcaactcattggtcgctttgataagctcctgttcggcgctctcggtgatggtaaaatactggtacgggtcctgattgataacgtgtccgttcgcctgtacataggctttttgtaacggatcgcgctcatccagccactgaccgtcaaactgacctttctctggcagccttgcgccgcgaatcgccagcgactgattcgcgatgtcaggctgtgacaaactgtattgcgtgtcgtcggtctggatcatccagcctaaaatcgtcgtgtcatcaaaggtgtcgcgcagggtgtaacacccgttttctacgaccatttccagttcgcgagtccactgctgccctggcggcaatggcgtgtggataacgttttgctcagcaatgcgaattttgttatccaggagttgggtgataatcgcgacgtgcccggtttcgttaaactcgccgcccttttgccagatgagcaacgccccggcctccggcgcgcgcggcgaaccgttcgggaaggcctgcaaaggcaaaatattgtcattcacgacctcgcgcagaaaacgcagcgagaaaatttcccaggccatgccgacgtcagtaaaaacaacgccataattcagaaagagaaaacggcgggcaaattccacgcactgccatttatgccccatgtattcatcgtcgatgtagctacgaaaagctgcgtcgtcgtcgtcccacggatcgagggaattgtaatctgaagagtagatcgctacgccgccgggggcgtaacccaataatgtcccgaagggggcatcctgactggtggttcctttgctcatgcacttacctcaaaacaagaccgcctgagcagcctggcgtgatttcgctctgattgtctgctctgtgacactaaccggacagaggtcgacataatcatacacctcaataaggcacactgaggccagaaggttaaaatttcactcgtcggaatgtcccaatcggttaaatgtccggttagcaagctgctacactgcttcaacaccaccactgtgaaggcaggtcaatatggcagataatacttatcaacccgcaaaagtctggacgtgggataaatccggcagcggcgcgttcgctaacattaatcgcccggtttccggcccgacgcacgacaaaacgctgcccgtcggcaaacatccgttacagctctattcgctggggacgcctaacggccagaaagtgaccattatgctggaagaactcctggcgctgggcgtgaccggcgccgaatatgacgcctggttgattcgcatcggcgagggcgatcagttctccagcggctttgttgacatcaatccgaactcaaaaattccggcgctgcgcgataactcatacaacccgccgattcgggtttttgagtcgggcgcaattcttgtttatctggcggataagtttggccatttcctgccgcaggatctggctaagcgcacagaaacccttaactggttgttctggctacagggcgcggcgccgttcctcggcggcggtttcggtcacttctatcattatgcgccggtaaaaattgagtacgccattaatcgcttcaccatggaagccaagcgtctgctggacgtgctggataagcagttagctcaccacccgtatgtcgcgggagaagagtacactattgccgatatggccatctggccgtggttcggcaacgtggtgctggggaatgtctatgatgcagcggagtttctggatgccggaagttatcaaaacgtacaacgctgggcgaaacaggtagccgaacgtccggcggtaaagcgggggcgcattgtcaaccggaccaacggcccattgaacgaacggcttcatgaacgccatgacgccagcgacttcgaaaaccataccgaagataaacgtcaaagttaaaccataatgccggatgaggtagtaatgtcgtcatccggcatggtattccctgctgacgcttcgcttatcagttctgcgagtgcgtcatatgcggcgcttcactaaacccatgttgcatgagaatcaacctcgcccgtgctgacagtaaaaagtcggcaagcgtttttccctgctcgctcaggcaggcaaagccatattcagccacgggattataaggttccgggatatcaaccactcgcagcgaattaacctgccgtagcctgggagcatagctggcatagccgataaagatatcggtgtaatcatgattgatgagccattccgccgccagccggcccgccggtaacggcaaagtctgtctgccgccaaccagcgctaccgcgcgttttcggatcgcttcgccctccttgcccatccgcgaaaaaagctgctgcgtataatcgccggaaggatcgcaacctgctgttgaggtgccgatccgcagatcccgccgggttaatagcgacagccagtcctcgccttcacgcatcgcctgtgcccgcacgctcagacacaaacggttcgtcgtaaaaggcgcgacccgcagtgcccgcccgctttccagcagcgcctgcggatgcgccaggttcgccgaagcaaaaaagtcgcatgcttcgcccgcttcgatgcgttcacgtaacagccccgccggaccgaaatcacataccgcatccgcctgaaacgccgtcattagctgcggccagacgacgcgcaagctccccgcagccagtattcgcatcactgtacgccctgatagtcagtacggtaaaaacgttgataccagtcgttagcggccttttgcatgtcaatatcgtggaatttttccggatagagttttttcgccatccatagttcgccgattcccaccgcctccggcatcggatatccccaggctttggcataatccggcatcaggtaaacccgatgatgcttcaccgcgtcaatgacctgccactggggattgtgcaggatctcattgacgacctttggatagcgattctggacaaagattacttgtggatcccaggcgatcacctgctccattgtcacctgcttaaagcctttcgccgaggatgccgctacattcagcgcccccgcatgggccatcatcagaccggtgtatttaccggaaccgtaggtggtcagctccggattcgccatataggcgcgaactcgctcattttcaggaaccgactgcaaacggtcgctgaccatcttgcgacctttattcatcgcctcaatcagcgctttcgcctcctgcggtttattgacgatatcgccaatcagcgttattccttcacgcagcccgcgattataagcctgctcttcatcggccagggtcgggttcattttagcctgctcgccagcaacatcatggcgcagcgaaatcgccaccaccggaatgccaagacggctgatcttgtcgatcatctcctgcggagcgtaattcgtgacaaacaccacctgcgggcgcagcgccaccagtttttcaggatcaacgtgcgttagatcgcccagcgaggctttttgcgccagttccggcgccagacgcgcatagccgtcgcctaattgctgtttccagttcgccatgaccccaacgattttgtcagtggcattcatctgtacaaggagattgagcgtttgatgctggagcaccaccactctgtcgagggtatcgggaaccgtgacctggcggccaagttgatcggtaaaagtacgcgccgcctgtgacattaacggccagcaaaaaagcaacgccagcagagagagctggcgcaaaaatttattcataggtttcgccccacaatcgatatataaataattatacaacgattatagagcgatataatagaggtgattaagggatcacgcgctggtgatgtcgtactccatgcggcgcagcgcatctaacgtggctttcgcttcgtcttcgtcaatgatgctcatcgcaaaaccaacgtgtaccaatacccattgccctatcagatcggctggcttaccttcacaaatcagagcaatattgacatcacgtttgatgccacacacttccacctgcgcaagctggtgaatatcatctccgacggccagcacctgaccggggacgccaatacacataattaaccacctgaaataaaatgcgggttattcgacctcaatactttttactttcaacgaatcgccggtatccacccgcaggcgatcgccatgacaatgcggacattgcgcgtcatgcctgagaatttccaccacctgactgcaatcccagcaccaggcctgggccggtctgtagtcgatgtgcaattcgcacccttgcgctaaagtcccctggcaggcgatgtcaaagctgaaacgaaccgcgcgctcttcaacgcacgaaagcgcgcctatctccagccatacgccggtgacgcgcgccacgccgtgctgttctgcctgctgctgaataatttcaacggcgctttggcaaagagacagctcatgcattctcacagctccgacggccaaacagcaacgcacgccggcttgtctgcggcgcatcaggattgcttaccggcagggataacagcatccgcgcgcagtcatccgccagccggacgccctcttccggcgacaggctacgggaaagcggcgacatcaacgagcaggcaagatattgtgaaacgccttccagttcgccaacggtaaaggtcatcgtgccataaggcagttgcagaccgagtttttcaccgacggtacgcccgggccagatctggtccgggccagggaagattaatgcgcttaacatccacggcgtaattaccgtgcccgtccattgtccttcaaacaacgtaaaatcagagacatgcacaggcatagtcggatgcagaaacgaaagatcgtgcatcgaacgatgggctatctcttcaaacgccgcctgaacccgggcgacgggcgccgtgtcgaatccggaaaacgtttcagacatgcgccgtctccttaggaattgcttcgacgccggattcacgcagcgcagcaagaacctgctcaagcgcaggttcaatcatcgcctcgacggttggcgttaagccgatgtgcggttccagcgactgtggaataacgccgaccagggtcaacttcttcggaaactcgccggtaaagcggagggccgacaatacgtcggccagtccaagctgatggggggagattttgttggtgaacagcgccggaacttcatcgtcgcgcagtaccataatggttcccggcgcgttctttttcgacacgatggcgtcggcaatgatcaaatgatcccgattcgccatatcgccaagaagttccattcccgccgtaccgccatccagaatctcaacgaaatccgacagggtgtatcgttgctctaacgcttcaacaatacgtaccccgatggcttcatcggtcagcaaaatattgccgacccctaagactaatatccgcattacaaaaccttcaccgagaccacttcattgccatcggcgtccaccacgtgcaccgcgcacgccatgcaagggtcgaaggagtggatggtacgtaccacttccagcggcttcgccggatcggcgatcggcgtaccgaccagcgactgttcgtacggccccacgtcatcgttgaagttacgcggacctgagttccaggtcgatggcaccactgcctgatagttactgataataccgtctttaatcaccatccagtgagacagcataccgcgcggcgcctccaggaagcccacgcctttgaactcgcccgtcgcctgaatgttcggcttcacaaacgtggtgtaatcgcctttgccgatatttacaatcagcgcgttgtattgatcctgcaatacgttttgcagttcacaacagtgaacggtacgcccgatgatacgacccagcgtagagtgaagttgcgccatttccagcgttttgccggtcagcttctgataaagcgcaatgatttcattgagcttggtctgcgtggattcacgacctgcggccagtttacatagcatgttcgccagcggcccgacttcgacggttttgccgtagaatgtcggcgacttgacccatgagtatttaccgtcatccgaccaaccgtcgtaagccggaatcgtggtgccttcccacggcgcctgcggcgcttcatctttataccaggcgtgcttcgcgctctcctgaatacctttaatcaggaattcatcggagtgagaggtgatcggacggtatgtcgacagatcggcattggtaatgtaaccgcccgggaacaggaaactgccgtttttaccgtcggtcgggaattccggcgcgctcaggtagttcaccgcgcctttgccgcgctccagccattccggatagtaggccgcgatgactgcggtatccactttatacacctgctcgacaaaatcgctcagcttatcgataaacgatttgatgtacatcaggcgttcaaggttcaacgtaccgatgctgtcgagattgatcgggttcgccaccccaccgaccgccaggttctggatatgcggcgatttaccgcccagcaacgccaccacgcggttagcgtcacgctgacattccagcgcctgcagatagtgggcgaccgcaatcaggttgacctccggcggtaactgcattgccgggtgcccccagtagccattggcgaaaatacctaactgaccgctagcgacaagatccttgatcttgttctgaactttcgtgaactcttgcgcgctgttcaggtgccagctcgacacgccatccagcatcgcagaagctttttccggatcggctttcagcgcagaggtaatgtccacccagtccagcgcagagagctggtagaaatggacaatgtggtcatgggtggtatgcgccgccagaataatattacggatatactgcgcgttgacgggaacatcaatattcagcgcgctttccgccgcacgaacggaggagatcgcgtgagttgtcgtacaaacgccgcaaatacgttgcacaatcatccacgcatcgcgcggatcgcggttcttcacgatctcttccataccgcgccacatggtgccggacgcccatgctttggatacgacgccgttctcaatttcgcagtcaatgcgtaaatgaccctcaatacgggttaccggatcaatagtaattctctggctcatgctttgctcgcctcatgacgattatgatcgttttgttttaaaggaggaagtatcggcagtagacgaatgagtacgatgtatgcacaaatctcaatagccacaaaaccaatagaaatcaacaattcttcccaggttgggaagtagtggtagccgccacccgggttgaatgccaccagcgaataggtcagacgccacgtcgcgcaacccaacagcgcgctcagcgccgacaggtacagcatacgagagtcattacgcagtttcgccacacgcagcaccactaacgggaagaccatcaggacgacttcaatccagaacatagcggagtaaaaatcgccggcaaacgcataggacagcttgtcgcgataaatcagttcgccaaagcgcaggacgacgaaaatcgccagcagcacgctgatggtattcgtcagcttaacaaacaaatttttctcatccggaccgtttcctttcaggcctgcctgaaccagcgccccctcaaatatgacaatggagaagcccatgataaacgcggtcagaaccgagaacagcggcagcatttcatagctttgccatagcggatgcactttatagcccgccgagatcatcaatgaccccattgaggactggtgcatcgtcggcagcagcgcgcccagcgcgataataaagaacatcaccttattcagacgcttgagcgacactttccagcccagacgttcaaacaaggcaggcgcaaactccagcgccatcacgccgatgtagatggtcatacagaccgccgtctcaaacagtaccgagttcacgttgaagtgacctggaatgtagaagtacggcaggttccagtaacgaccgacgtcgatagtgatcgacaggccgcccagcgagtaaccaaacaagcttgccagcaatgccgggcgcaccaacggatggtattgcccacggttaaagacatacaccgcccatgccaacgcccaaccgccgcaggcaaagccggtgccgatcaacaggtcaaaggcaatccagacgccccacgggaaaccgccgttcaggtcggaaacggagcccaacccgaagaccagacgcttcacgataaggagcatacacaggacgattaacggtccaaaaataatgaccggtttactgatgatttttccgcccagcggttttggatcatgactcatgatcgtctcctccatcgtgatggtcgtttttgctattacgacgaaccagcacggttaagcccgccagcgcagccaggggtagtatcatgcctttataaagcgtgtgttgaacatgctcggagcgcgctccggttgaaaggtcatccagcttcggcagatccaaatcttcataaggaacgcctgtcagcaccagcacctgagtaccaccgccctctttttcaccgtagaggtgtgggtagtatttaggcaccgtatgcagataggtgtcgtccgttttcaacgtctggcgcggatagtgatattcactgcctggtttgagggccagacgttttttcgcttccgccattagctcttcacgagtaccgaaaatgacggcccctgccggacaaacttccacacacccaggcaaaccgcctttatccagacgctcaacgcctttctggttacacaactcacacttgtgaagcgcgccaaacgggttgttgtagtcgtacttaggtacgttgtacggacaggcgaccatacagtaacggcagccggtgcagacatctttgtcatagtggacgatgccggttttcggatcttttttcagcgccgacaccggacaaacggaaacgcagttaggatcgacgcagtgcatacactgtttcttgatgtaggcatagccgttctcttcctgatctttgttcacgcccgtgccgctacgccatacctggataatgttattggtatacggcgacagtttgtcgttgttcgaccaggtctgctccccttccgggttacgcgccgggaagttgatatcctgacactttgtgacgcaggcctgacagcccacgcacagagtggagtcatacagcatgcccagcgaacctggaattggcggacggttttctgcagccgcatggctgacagacggcgcggcgcccaacagcaatgctccaccggaggctgctttaataaagtcacgtctgttcacggttattctccccgtgagtcagcgttatctttcttttgctgacgccccagttcacgtaccgccatcacgctgacgccggcaaccagaccgactacgccgccaagcagaccgacagcgcccgcagagatattgccgccttctttcatattgacgtcaggtttctctgaacgcggagtttggttttcgacatgagcaagctggtgaatgcccttatggaagccgataccttcttcgttacagccatagcaaggatgaccgatcgccactggccagacgccgccaacgtcacagaactgtaatgtagaacagttgccccaggtttccggccctttacagccaagatggtagaggcaccagccctgacggtggccttcgtcgccaaattctttggcaaaacggcctgcgtcgaagtgtggacgacgttcgcaatgctcatggatcagacggccataggcaaaggttggacgatttttcgcatccagcttcggcggcgtgccgtaagtgatgatatgcgcgacggtcgccaggaagttatgcgggtttggcggacaacctggaatattgataaccgttttgcccggtaagacttcctgcagactgacagcgccggttgggtttacgccagccgcagcaacgccgccccatgccgagcaggaaccgatagcgataatcgcggctgcgccgtcggcggctttgcggatgtgatccacgatcggctcgccggcaaccatgcagtagataccgttatcttttagtgggatagaaccatccaccaccagaacatattgccctttatacttctccagagcgttatgtttgttttcttcgacctggtgaccgaatgcggcggaaagtacctcgtggtattccagagagatagtctccagaacgaggttttcaacggttgggtgtgtagcacgaagcagtgattcggtacaaccggtacactcctgagcgccaatccagataacgggcggacgctgtggattggataccgattctgccatttctgcggcggctttgctactgagccccatagtagcggccagtgctgcacaaagcttcatgaaatcacgacggttaatgccgtgagaagtgatgagagtattatctccagtcattttatagttattccgttacgaagacctagcttttattttgcactgttcgcgaagaagttattgcgatcggtacgccatttaccacactttttttatggttatgtgcgccataatacttcgacggaacagtaaaacgaagggaagaggcgatagtgtaattaattaaagcaagataatacccctgttggatcaaccttcgagtcgataaccagccataaagaagcgaaccgccatcccggaatgattctctttaaagaaatccatcaccatttctttatccagaccatagcgacgcgtcagaattccggcctcccacgcgctaagttgacgatcgccggtcttttcgaacatacggtgtgtaaaacccaatacaaagccacgtttatactcagaacagaaattcaccgcatgatgcgcgctatatgcatatggcgcgtgcaacccggccattaaccctttcccaaaatgattattcatctgacctccttagtcgctatataataaattatatagcaactggttaaatgaaggccagcgcattacgcgcttttttgcttcacatcagaaggcaacccattcatcagtagactgtgcgggagccgacgccattctctgaacgccaggcgccgctttcgtcgttacgcgttgttgcggctcactagcggaaagccggaactgctgtacggagcgttgcaaatcctccgtctgccgttccagcgccgccgccgcggcggaaacctgctcaaccagcgcggcgttttgttgcgtaacgctatccatttgcgtgatcgccacgccaacctgagagatacctttactctgctcttcggaggcggacgcgatctgtttcataatcgtcgtcacttccgtgacgccgcgcaggatggcgtccatcgtcgcgccggtctcctagaccaactgcgcgccctgcgctacgcgacgtgccgattcgccaattaaagcttcaatttctttcgccgcccccgcgctgcggctggccaggttacgtacctcaccggcgaccaccgcgaagccgcgtccctgctcgcccgctctggccgcttctaccgctgcgttcaaggccagaatattggtctggaaagcaatactattaatcacggtagtaatttcggcgatctgctgcgaactggcggaaataccgttcattgtttctaccacatcggaaaccagttcaccgccttttcctgccgttagcgaggcggcatccgcaagctgactcgcctggcgagcgtgttcggcgttcatttttaccgttgcggtaagctgttccatgctggcggcagtttcttccagcgcgacggcctgttcttccgttcgggaagagagatcgttattaccggtagaaatttccgtcgcgccgcgccagatattgtcgcttccggcgcggatcgtactgacggcttcgcgtaaactgtcctgcatcgcgcgcagtagcggcaccaaccggcctacgcagttacgccccaacgcttcaatcggctggctaagatcgccttgcgcgatacgctgaaactgctgacggatgcgctccagcggtttcaccatcattgcaaccaaatagcgatcggtaaaaatcaggatggcaatgcccagaatcaccgccgtaataagcaggatgcggatggtataggttttaccatcgaccatcacacgggtgttatccagcatggcgccagcttcatgattaaaccgttccgcgctggcgccgaacgcgcggctaagtgcaggcgtgaccgtactggcatgttcgctccaggcggtcagcgatccttgctgcgccagttgcatttgaggaatgacgcctttctccagcaaggcctgccagttggacaacaccgcccttgagatatcagggttcatcggccctggcgatagcgctttcatctcctccagcttctgacgcatattctcgagcgactgccgggcgggcgcaaaatcgggcgtgccgccgccgatttttacatccatcgcgcggctaaggcgggtaacaaagcggaaatattgatcgttaccctggcttagcaccgtcatttgccgcacaagatgccggtcaatatcatttccttccgaaacttcggataaagcatggacgctgtataaacccacccccgaccagagtagacaaaaaagtcccagtatcgtcagcatgaccatacgaatagtaaagttttgcagcaaacgcatatgaatttccttgctgaatataagagattagtcatcagacgatgacgcactctcgttatcggcaaggcgcggagaatatataatgcattctccatttttttacagttatcgccgtttacgtacccgtagatgttatatatctgtgaacgcagagaaaatctttcagtgttattactgagtaaatgaatagatgtagtaaaaatattgcgtaaggctgcagggagacggttatccaccgttaaagaagcgctgttttacagccgggctcagcgtcctttgcccgactgccccgccgtggacggcggctcaatggttatgtcgcgtcaatctgtccagatagcccatcacgaacgccgacaggacaaaggtcagatggatgatgacataccacattaatttgttatccgggacgtttctcgcatccataaacacgcgtaacaggtgaatggaagagatagcaactatcgatgccgccaccttattttttagcgacgtcgcatccattttccccagccagttcagcttctccttgcccgcagagatatccagctgagagacaaagttttcatacccggagaacatgaccattaccagcaacccgccgaccagcgtcatatcaaccagcgataacagcaccaggatcagatcggcctccgccagggcaaaaacgttcggcagaacgtgtagaatttcctggaaaaattttagcgctaaagcgatcagcgccaaagagaggccaaaatacaccggcgcgagcagccagcgagacgcatacattacattttcaagaaagcgttccatagggacctgtcaggtaactaaaaccagcaacagtatatctcaaccatacaacatcagatcaacatgtcagttaaatctcatccggtttaacctgtgggcgctgatattccggccataccagcgcgaccaacgccgggtaggcttcaagactgaactcacgaaaacactggcgtaaattaaggacgtccaaatccgaatacggcaccttttctccgttcagacaacgcttctttatattgtcgtaatacttataaacggcagagttaaggtcgctgcaacgacgctgtgcgtcaaataatccaggcgtttcattcaactcagtcattgtcattcgttttatcgttgcatgaaggaaatcgatatattcatggttaacgcgccagtaccataccggcgttatcgaattcattaatactgagaaatgatcttcgccctcttcctttgtcatgggttcagtttgatttaaatttacggtttttccaccaggacgttttttattaacctcccacatcaggaagagtatcgcgccggtcagtaatagcaatataataacagaataaaaaatactgttcatagcaggctccattttttttgattttaaaattacaccatgttattgtcaacgaaacctacactattaaaaatagtataccactgatcgtaaaggatatttagtcatgcttcctgagcatctggtttcctctcattttcgcctgtcatcgccgccccctgaagccacagaaaacagtaaaaatttgtctcagggaaagacaaaactcagcgattacgagcccgatattttaatttgcgctaacgcaaccgggcaacacagaaacgtattatttgaagaacgcgaccgtcatattaaagaacgtctgtattgtgtggctaaaattgaaacgtttgcccgcctgataaacgcactacaggcagaaggcgatattgatgcccaaacgctaagtaaaatactggcggataaaaccgcaatgataaatgaaaaaggtaatgccatttggcttaatttaatcactcgcgaaaccaatatgccgctattttattcactggaagataaagatgaaagaagttgaagacaataacgtttatttggctttagacaaccataaaagtgatgaatttatcttaaagcaaaatcttgcagcgctaatcgccagtaaaaatgccactctggaaaaggtaacgcaggaagtggtatccataccggcggcgttagtgcgcctgaagtggcaaaaccgacgagagatgtatgcgttacaggtcaaagaggagatttatggcgcgaccatcaatgctattatcgagcagcatcctgaattacgagacaaaattatgtctcgtcttgaaagtgactggcagcatctgctggctcgcgagacggcaaccttacgtctgacgcgtaagctttccgatggcgactaccggacgcgcaacgtcaccacagtcgcacggcaagaaaaataaccttcatagctagttaactctgttgtgaatacgggcgaagcataaggatcgttctgattctccctcttacggtagtaaaagtgtctacgcttaaagggtgttcaacctgaagggagaagctcaatgtctcatctatacgaccctaccacgcagtattacaccggcgagtatcctaagcaaaaacagccggcgcccggcgtccaggcgaaaatgacgcctgttcctgactgtggtgaaaaaagttatgtcggcagtggtcgccttaaagatcgtaaggcgctggtgacagggggcgactccgggattgggcgcgctgccgctatcgcttacgcgcgtgaaggcacagatgtcgcgatcaactatctgccagcggaagaagaggacgcccagcaggttaaagcgctgattgaggagtgcggccgtaaagcggtgttattgccgggcgatcttagcgacgaatctttcgcccgttcgctggtccataaggcgcgcgaagcgctgggcgggctggacattctggcgctggtagccggtaaacagacggcaatcccggagataaaagatctaaccagcgagcaatttcagcaaaccttcgccgttaacgtttttgccctgttctggataacccaggaagcgattccgctgctgccaaaaggcgccagtattatcacaacgtcgtctatccaggcctatcagcccagtccgcacctgctggattatgcggcaaccaaggcggcaatccttaattacagccgcggcctggcgaaacaggtggcggaaaaaggaattcgcgtgaatattgtcgcgcctggccctatctggacagcgctgcaaatttccggcggccaaacacaggataaaattccgcagtttggccagcagacgccaatgaagcgggccggtcaaccggcagagctggcgccggtgtatgtctatctggcaagccaggaatcaagttacgttaccgcagaagtgcacggcgtgtgcggcggggaacatttaggctaacgcatgaagtcgattaaggtggcgcaattctgttaagcaaggcgccatcttaggcaataaaaaagccgggtggcgacttcgccttacccggcctacagcatcagcagaatacttatttcgctttcgcggtctcttcgccgaccaaaccaatcttgagatagcccgcctgatgcagcatatccatcactttcatcagggtttcatactctacggttttatccgcacggaagaaaatcgtagtatcctttttcccttccgtcagggccgttagctcggcaatcatcgtatcatccgtcaccggatcgttaccgataaacatggtgttatccgctttcaccgacagataaaccggtttttccggacgcggctgtggcgtactggtagaagcgggcagattcaccttgacgtccaccgtcgccagcggcgcagccaccataaagataatcagcagaaccaacatgacatcgataaacggcgtcacgttgatttcatgcatttcgccgttgtcatccaggttctcgttaagacgcattgccatgacgcattaccctacccgtaatttctgcgcggcgcgtaccggctgcgcactggcgctcgcattcagatcaagatcgcggctttgcagcagcaatacctgcgccgccacgtcgcccagcgtcgctttgtaactgcctatctgacgtgcgaagatgttgtaaatgacgaccgccgggatcgcggctaccagcccaatcgccgtcgccagcagcgcttccgcaataccaggagcgaccaccgccaggttggtggtctgcgtttgcgcaataccgatgaagctattcataatgccccatacggtgccaaacaacccgacgaagggggaaatggcgccgatcgtcgccagataaccgttgcctcgtcccatgtagcggccaaccgctgcgacgcgacgttccagacggaagccggtacgttctttaatcccttcgttatcttcgctgccctgagagagttccagttcattctgcgcttcattgatgagctgtgcgctgaggctttttgcgctgaaacctgccgcaatgtcggaagcctgatctaaagagcgcgcatcggctaattgcagttgttcgcgctttaagcggcgcttttgcgtgaaaaattcaacgcttttactgaagaagatagcccaggtgacgactgacgccagaatcaaaccaatcatcacgcacttcacgacaatatcggcgtgctgatacatgccccagacggaaagatccgtctgcatcaaattattacccactctgtatctccaggacgcaaatcacaaaatctgagcataataatatcaaaacaacgtcgaattgatagtcgttctcattactatttacatactgccgcacctttactgctttttctttgcgcttacgcattaaaaaagccacctgtttttattttggcaaaattttcatctgtatcacacatcgccagggtgcagatggttatattcatgctagtttagacatccagacggttaaaatcaggaaacgcaacatgacggataaacagttggataccaaactggtaaacgcaggacgcagcaaaaaatacacgcttggctcagtgaatagtgtgattcaacgcgcttcttcactggtgtttgacaccgtcgaggccaaaaaacacgctacccgcaatcgcgccaacggcgaattattttacggacgccggggaacgctgactcacttttcgctccaggaagccatgtgtgaactggaaggcggcgccggatgcgcgctcttcccgtgcggtgcggcggcggtcgccaacaccattctggcattcgttgaacagggcgaccacatcctgatgaccaacacagcctatgaacccagccaggatttctgcagcaaaattctcggcaaactgggcgtgacgacaagctggttcgacccgctcatcggcgctgatatcacgcaacatattcagccgaacacgaaagtcgtatttctggaatcccccggttctattaccatggaagtacatgatattccgaccattgttagtgcggtcagacgcgtcgcgccagacgccgtcatcatgattgataatacctgggcggctggcgttctgttcaaagctctggaattcgatattgatatctctatccaggcgggcactaagtatctaattggtcattctgatgcgatggtcggtactgccgttgcaaatgcgcgctgctgggaacaattgcgggaaaacgcctatctgatggggcaaatgctcgacgccgacacggcttatatgaccagccgcggtctgcgcacgctcggcgtccgactgcgccagcatcaagaaagcagcctcaaaatcgccgcgtggctggcgaaccattctcaggtcgcgcgcgttaatcatccggccctgccgggtagcaaaggtcatgcgttctggaaacgagactttacaggcagcagcggcctgttctcctttgtgctcaataaaaagctgaccgaggcagaattatcagcctatctggataacttttcgctgttcagtatggcctactcctggggaggctacgaatcgctgattattgctaatcagccggaacagatcgccgcgattcgtcccgcaggcggcgtagattttaccggtacgctggttcgagtgcatattggtttagagagtgttgatgatttgatcgctgatttagccgccggcttcgccagaattgtgtaaagttgccgtggatggacatatatgcagacaatttccgtggaaaagtctgcgtttgttgcgtccgggatcaaggcatcccggacgattcaggagtacaataggcagataaaagcgtaaatgctgttccacaggaaagttcatggctgtcattcaagatattatcgctgcgctctggcaacatgattttgccgcgctggcgaatccacacgttgttagcgtcgtctactttgtcatgttcgccacgctatttttagaaaacggtctgctgccagcgtcattcttacccggcgatagtctgctgctactggcaggcgcgttgatcgcccaggatgtgatgcattttttgccgacgattggcattctcaccgccgcggccagtctcggctgctggctaagttatatccagggacgctggctcggtaatacgcgtaccgtcaaaggctggctagcgcagcttccggcaaaatatcatcagcgcgccacctgcatgtttgaccgtcacggtttgttagcgttgcttgccgggcgctttctggcgtttgtccgcacgctgctgccaacaatggcgggcatttccggcctgtccaaccgccggtttcagttttttaactggttaagcggcctgctgtgggtgactgtcgtgaccagcttcggctacgcgctcagtatgatcccgtttgttaagcgccatgaagaccaggtaatgacatttttaatgatccttcccgtcgcgctactggtcgccgggctgttaggtacgctggtcgtggtgattaaaaagaaatactgtaacgcctgacgtatccataatcggccaggatggcccggttacgcttcgttgccccgtggcgggatgccccacttagctcccttgcattgtccgcattcttgccgcatcttcgcccggcgtaacgccaaaataacgtttaaactcccggctaaactgcgatgcgctctcatagccgacccgcatcgccgcggcgctggccttcataccgtcgtgaatcatcatcatccgcgctttatgcagtcggtagctttttaaatactgcaacggcgaggtgctggtgaccgccttaaaattatggtgaaacgccgacacgctcatgttcgcttctgccgccagttgctcaacattcaggttctcggtgtatttcatttcgatctgtttaagtacgcgactgatcaggctaaagtgcgtctggcgactaaccagcgcaagcagcgccccgccgcgcggccccatcagcacatgataaagaatttcgcgaataatctgttttcccagaatccgcgcatccagcgggtgctccatcacatccaacaatctttccaccgcgcataaaatctcgtccgacagcgtggcggagttaatcccgctggccgccatcggcaactggaaacgctcatcttcgccaatgtccatgagcaactcttgcagttgcagcacatcaatgtcgagccgaataccggccagcggtacctccggcgtcgcccaggtctcgcattcaaaagggagcggcacggtcagtaagagatattcattagcgtcataacgaaacttgcgcttgttaatatagccaattttatggccggaaaagagaaatatgatgccaggctgatacatgaccggcgtgcgcggccccggttcaacaccatacaacagacgaatgcccgccagccgctcgctgattattttatcattattttttaaatgattaattttatcagccaactgtaagcaaattgcttcacgattcataacgcgccatttttttatcaaatccactccgctggattgtgcgcatttttagcgattttctccagcattctggagaaataggcaaaacattggcagaaatgtgcattgagagacatctctcacaagaccacaatgatgaccatcaggcagacagccgcctgccctctttttacccacataagggaatgagcaatgaaaaatttcaaattacatacccctacccgcattctgtttggtaaaggcgctatcgtcgatctccgcgatcagatcccgcaggacgcccgcgtgctgattacctatggcggcggtagcgtgaaaaagaccggcgtactggcgcaagttcaggacgcgttaaaaggactggatgttcgggagtttggcggtattgaaccgaacccgtcctatgaaacgctgatgaaggccgtgcagcttgtgcgcgacgaaagtattaccttcctgctggccgttggcggcggttccgtactggacggcaccaaatttatcgccgcagcggcgcagtatacggacggcgtcgatccgtggcacattctggaaaccggcggtactgagattcgtagcgcaatcccgatggggtctgtgctgaccctaccggcaaccggctcagaatcgaacgccggcgcagtcatttcccgtaaaactactggcgacaaacaggccttccactcctcgttcgtgcaaccggtgtttgccgtactggacccggtctacacctatacattgccgccgcgccaggttgcgaacggcgtcgtggatgctttcgtccataccgttgagcagtacgtcacttaccccgttaacggcaaaattcaggatcgtttcgccgaaggtattttactcacactgatcgaagaaggtcccaaagcgctgcaagagcctgaaaactatgacgtccgcgctaacgtgatgtgggccgctactcaggcattgaatggcctgattggcgctggtgttccgcaagactgggcgacgcatatgctgggccatgagcttacggcgatgcacggtctcgatcatgcccagacgctggctatcattctgcctgcgctatggaacgaaaaacgagacgttaaacgcgcaaaactcctgcaatacgctgaacgtgtatggaatatcaccgacggttccgacgacgagcgtattgatgccgccattgccgccacccgccgtttcttcgaacagatgggcgtgcctacccacctgtccgattacggtctggatggcagcactattccggcgctactggccaaacttgaggcgcatggatgcacaaatttaggtgaaaatcaggatattacgctggatgtcagccgtcggatttatgaagcggcgcgctaaggttttttcgcctctgactttcgtttttggccatttcgtccagacttaagtcacttagtctcgccggacccgactccggcgagccaattaaaagaggaacacatcatggctaatccaaccattatcaggctacaggatggcaacgtaatgccacaacttgggctgggagtctggaaagcaagcaatgaagaggtgatcgcggcgattcataaagcgctggaggtgggctatcgatcgattgataccgccacagcatatcagaatgaagaaggcgtcggcaaagcgctaaaagcagcgagcgtggcgcgggaagagctgtttatcaccactaagttgtggaatgacgatcaaaaacgtccccgcgaagccctgcaggagagtctgaaaaaactgcaacttgattatctcgatctctatctgatgcactggcccgtaccggctatcgatcactatgtcgacgcctggaagggcatgatcgcgctgcaaaaagaggggctggtaaagagtatcggggtctgtaactttcagatccatcacctccagcgtctgatcgatgaaaccggcgttccccctgtgatcaaccagatcgagcttcaccccttgatgcaacagcgccagctacatgcgtagaatgcgacgcataaaatccagaccgagtcctggagcccgctggcgcagggcggcgaaggcgtattcgatcagaaagtgattcgcgaactggcggataaatacggcaaaacgcccgcccagattgttattcgctggcatctggactgcgggctggtagtcattccgaaatccgtcactccttcccgtatcgcggaaaactttgctgtctgggatttccgtctcgataaagatgaattaggcgagatcgcaaaactggatcaaggaaaacgcctcgggcccgatccggatcagtccggcggttaagccggatttatcgcacgccatgcccgacgatgtcgtcgggcttttttgcattccgaaacattaagaaacaattacgcgcatttaacagtatatttcccccacacacaagcgcagaattattctgattttgtgaatatttattcacatttattatgaatttacttaatacatataaaatatttatggatgtgtgattgtggcggaaaaaaaatctcagggcgtcaaatggctcccattcattcttattctggttatcgccgccggactgtggcagctaacgcccccttccgggttaagcgcgccggcctggcattccgcgattatttttgtcgcgacgatcgcctctatcgtggcgaaagtgctgcctattggcgcggtcggtattatcggcatcaccgtctttgcgctcgcctatgctgccggcgacaaaacggccagcggcgcgattaccacggccttgagcgagctgaacagttcgctgatctggcttatcgtcgtcgcctttatgattgcccgtgggtttatcaaaaccgggctgggtcggcgtatcgccctacaaatgatccgtctgttaggtaaacgaacgctgggtctggcttatggcctggcgtttgccgatctgatcctctcccccgcgatgcccagtaacaccgcgcgctgcggcggcgtgatttacccgatcgccgactcgctggcgcgcagctttgattcacatccggaagatgagtctcgcagcaaaatcggcacctttctgatcacctgtattggcaatgttaacgacgtcaccgccgcactgtttatgaccggttatacgggtaacctgctggcggtaaaactggcggcgaacgccggcgttacgttgagctggggaagctggtttattgccgcgctcttgccttgcctggtctcttttcttatcgtcccgctgctggtctactggctgacgcgtccggaaattaaacatacgccggatgcgccggatctggcgcgcaaagagctggcgcaaatgggcagtatggcgcgcggcgagtggctcatgctggcgaccgtcggtgtgttgctggtgctatggatttttggcagctcgctcggcgtggatgccacgacggcctcttttgtcggtctctctattttattactgagcggcgtgctcacctgggaagacgttaaaagcgaaaaaggcgcctgggatacgttgatttggtttgccgcgctgctgatgatggctaaccagttgaaaaaactaggattcaccagttggtttggcaacctgattggcgacagcatcggcagtacgatgcatggaaccagttggataatcatcctgctgctgcttaacgcagcctatttttatacccactattttttcgccagcggcaacgcgcaaatcgccgcgctgtatgcggtgtttctgggtgtcggcctgcatctgaatataccggcggcgccgatggcgctcatgctggcgtttaccagcagcctgtactgctctcttacacagtatacccacgcacgcggccccattctttttggcgccggctatgtaccgacgggcatctggtggcgaacgggatttattatcagcctctttaaccaggcggtctttttgacagtcggcctcgcatggtggaaagtgttagggttgtattaaacgcttaacgcatcgataaccccctcggttaacggagaaatggaatgacctgcattttctgtcaaatagttgaaggtaaagcaccttgtcataaagtttgggaagatgagcatcacctggcttttttgtcgatttttccgaataccgatgggtttaccgtagtgatcccgaaaaaacattaccccagctacgcgttcgatctaccgccgcaggcgttagcggacctgatgctggcgacccaaaaagtggcgaagaaactggataaggctttcccggatgtcagtcgtacgggaatgttcttcgaaggtttcggcgtagaccatgtgcatagtaaattaagccccatgcacggtactggcgatttagcccactggaaaccgattgaatcgcggcagaataaatttttcgaacagtatgaaggatacctgtcgtcacacgatcatgaacgggcagctgatgagaaactggccgcgctggcggccagaattcgtgaggcataaatacggagcacttctgccggatggtgttcggcctgggtcgatctgtgggcctgataaacgcagcgccatcaggcaaaataattgctggatcgcggcttcgccttatccagcctgacaggatacctgtaaaaccgtttaacgccccgcgcctttcccgcgcttcttattagcagcaagcccctgccgctgatgttccaccggcgtatgcttggtcaacgccgggcgggtattgcggttctggcgacgcgcttcgcgcatctcttcaatagtcggcgcaggcaccagacactcacggcgaccgccaatcaggtgctttttgcccatcgcttccagcgcctggcgaatcagcggccagttcgccggatcgtgataacgcagcagcgccttatgcaggcgacgttgcctgtctcccttcggcaccaccacatcttcactcttataaccaattttacccagcgggtttttgccggtgtaatacatggtggtcgaatttgccaacggcgacgggtagaagttctgcacctgatccagacggaagcggtggcgcttgagccacagcgccagattcaccatatcctcgtcccgcgtgcccggatgcgcggagataaaatatgggatcagatactgctcttttccggcctgtttagagtaaaggtcaaataactctttaaagcgatcgtagctgcccatacccggcttcatcattttcgacagcggaccttcttcagtatgctccggcgcaatcttcagatagccgcccacatgatggcttgccagctctttaatgtagcgaggatcttctacagcgatgtcgtagcgcacgccggaggcaattaagattttcttaatgcctttcagctcacgggcgcggcgataaagattgatcgtcggcgtatggtcagtatccatatgcggacagatatccggatagacgcatgacaggcgacgacaggtctgctccgcacgcggcgacttacagcgcagcatatacatgttcgcggtaggaccgcccagatcggagatcacgccggtaaaccccggcaccgtgtcgcggatcgcttcgatctcgttgataatagagtcttccgagcggctctgaatgatgcgcccttcatgttcagtgatcgagcagaaagagcagccgccaaagcagccgcgcatgatattgatcgaaaagcggatcatctcataggccggaatacgggcattgccgtaagccgggtgcggcacacgctgatacggcagcgcaaacacgctatccatctcttcagtggagagcggtatggcgggcgggttgatccagacatagcggtcgccgtgtttttgcatcaacgcccgcgcgcagccagggttagtttcgtgatgcagaatacgcgacgcatgggcgtacagcaccttgtcgcctttcaccttttcaaaggatggcaacaggatataggttttttcccacggcttcggacgcggcggctgcacggtaatcgccttagcttcttgctttttcggcgcgaccggcttgttatccgcgcacggcagatcctcgccatagggatggggaattggatcgattttacccggcgtgtccagacgagtggagtcgacgccgctccagcctggcagcgcttctttaaccataatcgcagtgttacgcacgtcgcgaatctgatcgatggtttcgcccattgccagacggtgcgccacttccaccagcggacgctcaccgttgccaaacatcagcatgtcggctttggaatcgactaacactgaacgacgcacagtatcagaccagtagtcgtaatgcgcggtacggcgcagactggcctcaatgccgccaaggatcaccgggacatctttccacgcttctttgcaacgctgggtatagaccagcgtggcgcggtccgggcgtttgcccgcgacgttatccggggtgtaggcgtcatcgtggcgcagcttacggtcagcggtgtaacggttgatcatcgagtccatgttgccagcggtgacgccgaagaacaggttcggtttacccagacgcataaagtcgtctttgctgttccagtccggctgggcgatgatccccacgcggaagccctgcgcttccagcatacggccgcaaatcgccatgccgaagctcggatgatcgacatacgcgtcgcccgtcaccagaatgatgtcgcagctatcccagccaagttgatccatctcttcacgtgacatcggcaaaaacggcgccggcccaaaacaggcggcccagtactgcggccaggagaaaaggtcgcgatccggttggatcagggagatagcgctcatattgcttccaaaaaattggcaaaaaaataatcaaaggtcggggattataagctggaatggaagagaaatcgaattgattggtgaggctgcactctgtagcggggccgattgcctgccccgtcggttatcgtacttatggacgagcaggcatatctgctactttgataataggattttgttcttcgagcaaattcaacagtaccggcgtgacatgatacatggattctgcaatcatgactttccctcgcagggtgattttcttccctataaaccgttgataataattgtatttttcaggcggaagaatgagctggacatagcgatcccagtcaggttggtccatcatggcccctgccacacactgaaggtttattgtttttaattcgagatctttatccgagtgttggccttgattatcttcaatgacgtgctcgcgtttgaccatcataccttccagttcaatcgtgtcaccctctttgttgcaggaagaatcaaagttcacataagcgagaacatatttccctttcttttcatcaaactcaaaagtggaattgtaataaatacctaaaggttcgctgtataaaaaggagtagcgcttatagctctcgatatcgcgttgacagtttccgccgccattgatcattaagtctctgtatttttgccatactttttctaaattgattggctgatctgcaccagtcgtaaggtattctgccgtattgtccatgacatatttgatattattcgctttcagcgcctcacaaaaatcggttgtgttctgaatatacagcgcctttttacgctgtgactcaggagaaagcagctctttgaggagtttgatattacgatgctctgtctcggtaatgaggtaatcaacgttcgcatagcgtgggcgataccacggctgctgtcggaagtaccgatccatctcaccgcccggtctgaaaatataaccgtgacgagcataaatctcattaagcataattttaagatcggctatcgaggttgcgctggtttgcacgcttcttacctgaagccaggtccgcgaggcttcaggaaatcggccttccagcgtgatgtgctctatctgcggtgcaaaagcaagatagctgccgtaatccaacagagttcccttcgtccccatgggaatgagtcctttccttttaggcgtcacgagaaaatcgatacagcgcgtatgctcacttccagtaatcaccgaatggtcattctcttgttcaaaaaactggatgtcacaccacggcgcgccactcatcatagaaaaatcgtcaggaacaacgcgctgccattttcgaacgtcgggcaactcagcgtaaaacctgagccactcatctgcagtggcggtataatcatcgttttcgctgccataaaagggttcgcgactgtcaccgaaaaagataaagtcattaagcgtgtagtctgtgaccttgccctgaaaatagatttttttattttcgatctcagggcggaattttagttccgcattagctgagaagataaacaggcacataaatataaataaaaaacattttttcattatttaccactccctgtatctctcttaacaatcaatgtaattttaattatcagagcacggcatatcagtctaaatcggcgcactgctgtgctaattttatacgcacattggtacgccgcgtatcttctggtggatacaccttatcgatcattgcgttaagcttgttacagtccaaccaggccatccggtaggcagtcatcaggctatgcctttcatcctggtaatcaaggctggctacaataagggcttccgacaacgccgtatgttgctgttgcatactttgcagtatccccgccagaatatccggcggcagcgcgtcctctttcgaggctgtatgcaatgtgcgtgaaatcaggaaattccagccgtccgtcaacttatcctgagggatgtgctgccagttcagcatctgccctttcaccaacgcacgcagcgtctcgccatccgcatcaataaacagcgacgccagcagatttttattcggatagaccgactgccccagcacctgcggcgtcagttttatctgggcaagcagcgctttagtttgcccctgcaacaagaaataatatgcgcgatacagcggattttgcgcttcacgccgctgccagaaaaaggccagtgtctctttatcctgaagctgtatcgcccccgaataggcttcatcggtgaggagatcgggcatgacccgtagcagaatgtcggccatctcaaaaaaagtctggcgaaatccctcaggtttaaaacggggcgtggggagatactccaacggattttgccgccgtacgatggtgcgatttgcctgcgcctgcggggagtcgcccatgagctgctcgctaaaaatacgcaccgcagtgatattgccactctcaaaagcagcaaaaaatggcgcattgacgaaatagccatcttcccgcgagaacctaaaaggcgatgccacacgtgcagtcagatcgcgcaagtttttttctgatatgcctggcgcttttaccgcctgaaccagtgtctgttccaacgtactgttatcatgaatgctctctaactgacgcaggtcgcctgcctgaacctgcctgagcaactgcgcaatattttgctgttgccattgatagctaatagcacgccacagctccggcatcaccgggcacagcatcccaatgaacacaatatggcacagtagccatgcgggccacggcttgcgcagccaggttcccagcagcagcgcgggcagcaagcccgcccaactcagaatcggcaacaggagcatcaacatccataccgtgcctgtttgactcaacaactgggtgtactgcaacgtgggtaacagcaataccacgaatgcccactgtggtagtaatacccacagcaaaatctgtcggctgcgttttttggaaaacatcaggatcagcagtgatgccaccgcagcggcatacccccacggtagaacacaaaacatcagcagttcagagccaagccatcgattaatataatccatttactattcctttagtcacttcgcgactggacacagcgcattcagcctttgtcgcgtatcgtgtagtacttgttcgctccccactactaaagcattcaacacctcacgcaattgctcacaggaaagcccagcctgtaaaaaagcggcaggaaacgtcggtgtccagggaagatagtgggcgatttgctcgttggataacgctttctgcgcttgcatcgccttaatgatctgtatcagcaatgcgttctctaatgctccaccacgcagtcgtaatatggcctgatgcagaggctcattatttccgtcttccattgctcgtttccagtccactacgtttgcatcaataagcgactgaatcattaccagatcgccattgctcagtatgaaagtgagtaggttttcacgatcccacctctcaatcggcggtgtgatcaatatttctggattatgggttacctcgcttattagcgattccgttttggctaacaacaccatcgcttcgagcctgcgcagaggaatagtgggagggtgtttctgccaaaaataagcaaccaactcagtgttacgttggataatgggataaatatagacagtatcattcaacagttctggcataatattcagcaatagctgactaatttctagtctgtactgctcgcgatactgtgatatatagttagatttataaagcgtcagcagtggattttctttacgagcaacaatattgcgattctctctggcggaagatgtctcgcccaccagttgctggctaaaaaagcgtactatcggtacgttatgttggcgaagagcggtagcaaatggcgtataaagaaattcggcgttcgggatcgccgcttcagggcaagattctgccgctgtcaaaaatggcgaaatacctcgtattttagccagataacgcaataaattttccggtgtatcgcggtgttctgcagccagcgtcaaaacacttgccaattgataacaagatgcatcctgcaaaacctgaacatcccccttcgcgcgctcaaacagtcgggtaattttatagttatctcagtcttcaccaatgtggtgccataatcgcgggccgtccatcacataaacgaaaacgaacaaaaaaatagtatgggacacgatagttcccagtataaaaaatggagactctcgactagaaaaaatagcaattattatcgagggcagcaatcctgatatcaataaatatacgatataaatatcttttgaatcaatccagaataatcctccccacactacacagacaacgctcacctgcggaagaacaacacgcaagaaaacccgccgatagcgcaaagaatcaaatgcgccgacaattaacctcaataatacaacgccataaataccccacgcgctcatcaatattactgaatcccacatcatccacgcaaatgattcacccataaagtatccttactttccatgctcattactgagttcaaattcctcgttcctattttccgataacacagcgagctaaacgcactaataactatagtaaatacaatgattgtatatattgcccggcacggaggatattatcatcaacaacaaactccatccgtttcccaaattcattattgcccgctattttttctgatgataaaacacatcaaattcaaactgccatgagaaaggttccggtttgttgctattatcaaaggcaacggcttgtgcatacagttcgtccgtcaataattccggcacgacgctaatcaaactggtacaaatatctcgcgccaaaagttgttgttgcagaaaagtttgttcatcagccgtactatcattaaaaacacgattcagtaggtccaataatggattgttttgtaagagctgatgccgatattgctttgcctgtacagaatcgccaataaaccaggaggcaaacgtcccaacagcagaacgattaagccggtcgatggccaaaaccaaccaaattttttcagttccgcccgcaatatcaaaaggggaaatgcgttttgcgagatgctcaatccgcctattcgtcccccaatcccctgcgttttgcggctgcatggcttgcgacatcaaatgatttaaaaaaacgcggtcatcagtcgtatcgatttttcgtaacagcgtttcttccgccacctgctgtgcctgataggcatcgcgccgatgatgcctatcgagaatatcccccatgtgcgccaacaacagcagcaatacgaccacatagcacccggcccaaaggtggtgtggttggcgtaatcggtggctaaacagtagcgccaacaataaactaagccccagcatccaccctgcactaatcggaaagaaaagcgtttcatcatccgcagcaaaccatagcaaaagaaccagcgcaatctatggcaaagcaatccacagcaacacgcgacgaggcgtttggaacaaaaaagccaggcaaataacaacgaagagcagaataagatagccgcctgtagtaaacatccagaacgtcagtagccgccatccctcttcattgattctcatcgaatatccctggttcgcctttacgacgccggattcaccagcatttgcccaatcgagccgcgatcagccatttccagcgtctggctgttgaaatagaacgggaagtgcggccaggacggctgaccgtagtagaccagcaattcgacttgcccatccacccagacggtatctttccagcctctatcttccgggaacggcatagcgccgttgacgttacgaatcaggaaagagacgccctcaatatggaacgactgcggcatatcggcgcgtaccgtccagcgctcccaggtgccttgttgggcggtaatatcaatgcgattcacatcccacagttggccgttaatccccggatcgtcgccaagactgatgtcccgactgcggacaggcgcgccgctcatgatctccgtcggcaacagacgcatcggcagattatcggtcaccagcggcagcaatccggttggccgtaacgtcagcaccagggtcgaaaccagaatactggaaggctcaaagaaaccgcgaatccgatcgactatgctggccgcttccccgcaggtgatcgagacttcgtcgccgttggtcatatcaaccaggatttcacgtcgctcgccgggcgccagtgacaactgtttgacggaaaccggcgcaggtaaaaagccctgatcgcctgaaatcacatgcagcgcccggccatcgctcatctgaagctgatagcgccgcgagttcgaggcgttcaacaaccgtaaccgcacccagccgcgggacacttcgacataggggctttgcgcgccgttcaccagcagcgtatcgccgacaaaaccaccgctgcccggttcgctgtactccggcgtcccaaagttatccagccgtttatcctggataataacgggaaaatcatccacgccgtaatggttcggaatgggcagcgttttactgatgtcatcttcgaccagccacattccggccaggccgttatacacctgctgcgcagtgcggttaggcgtgttagcgtgataccacagcgtcgcggcgctctgacgaatcggcaacaccggcgcccagtccgcgttcggcgacatcatacgcgccgggccacccatcagcggccccggcaccagtaaaccagcaaccgtcatggagacattttccgccaggcggttgctatagatgagtttaacgtcatcgcctttccagacgcggattgtcggccccagataacgaccgttcactccccagaccggcgcgcgcgtgccttgcgtaaaggaccagtgcgctcgctgtagcgtcataaacaacggctgcccgcgacgggactccagcaacggcggaacaggcaacggctgttgctgaccggcagcattcgccctgaggggaatcgcgcctgcacatagtgcgattcccgatgcctgaagaaactgacgccgactgaatgacatataagctccatgtaaaacaggctaaagagttgtgcctgaaaaaatgatttctacaataacagagtaaggctgcttaaaccttaccggtcgcttcacgttccgcaacctctttatcaagttccgcgattttttgctccattaacgcacggcagtgggccgccagctcacgaacctgatctttaccatattcgctgacgtcgactggcggcagcatttccacaataaccagtccgttgttcaggcggtttagattgactttgttagaggtgttggaaacgcagacaggaatgatcggcacaccagccgcgatagccgcatgaaacgcgccggttttaaacggcagcagaccgcgtccccggctacgcgtaccttcagggaacatccagatagaaatacggcgctttttaaaatggttaactactgccgcaatggtgctatgcgctttggcgcggttattacggtcaatcaacagattaccggtcagccagtacagttgcccaaaaaacgggatccaaagcaggctttttttccccaccgtcaccgttggcggctgcacaatattcgccgccgtgaccatatcataattattctgatggttagcaatatagatagcattgccatagttttccgcatcggcgggtttgcggcactccactttcaggccaaacagcggggccagacgaccgaacatatgtccaaacgtcgccacgtgttttgggttacgtgggctgaaaaggcagtaaatagaaccgaaaacacagaccagaatggagtaaataacggtaacaataagacgaaaaatatatagcataacaacctctgaaggcctaagagcccggcattctacgtcacctgaaattcaggttaggattttggtaagtgtggctctctggaaaaacgtattgttaatcgcaatgcacgaataaacaacggttttacgggaaattttaatgttaatccgatctgaaaccgtaggccggataagacgctactgcgtcgtcatccggcaacggcagagcgccggatggcggcttagatgccttgtccggcctacgggcgcccctgtcttactcttcgctgtcgccatgacttacgcgatgcggcgaatcaatctcaatgcgatcgatacgctgcaggccgcgcattaatgtgccacggcgtccgcgttcaccgaccaccttttgtaactcttcagggcgcagtttgattttgcgcttcccgacatggatagtcagagtgctttgtggcggcagcacgtacaggtgcgccagtccatcatcgcctttcgccgcttccgcagaggggatattaatgatcttattgcctttgcctttcgacagctgcggcagagagtctaccgggaacatcaacatccgtccggcctgggtaatcgccagcagcatatcgtgctcgtctttaatcaccagcggcggcatgacgtgcgcattttccggcagtgtaatcaacgtcttaccggcacggttacgggcaaccagatcgttaaacgtacaaacgaagccgtagcccgcatccgacgccatcagcagtttctggtcatcgccttccatcagcatatgctctacggtcgcccccggcggcagcgtgagtttgccggtcagcggctcgccctgcccacgcgccgagggaagcgtaatgggatcaatagcatagctgcgcccggtggtatcaataaacaccaccggttgattgctcttacctttcaccgcggctttaaagctgtcgcccgctttatagttaagccccggcgcatcaatatcatgacctttggcgctgcgcacccagcccatctgcgacagcacgatagtcaccggttcggacggcagcatatcgtgttcgctcatcgctttagcttcttcgcgctcacgcagcggagaacggcgatcgtcgccataggcatcggaatctgcctgtagctcttttttcagcaaggtattcattttgcgttcggacgcgagaatgccctgcaactggtcacgctctttttccagctcgtcctgctcaccgcgaattttcatctcttccagtttggcgagatgacgcagtttcagttcgagaatcgcttccgcctgggtttcgctgatgccgaaacgcgacatcagcgcgggtttcggctcatcctcgttacggataatctcgatcacttcatcgatgttgagaaacgccaccagcaaaccttcgaggatatgcaggcgcttaagcactttctccagacgatagttcagacgacggcgcaccgtgtcgcggcggaacgccagccactcggtgaggatctccagcaggtttttcaccgccggacgaccatccagaccgatcatgttcaggttaatacggtagcttttttccagatcggtggtggcgaacagatggttcatcacctgttccatatccacacggttggagcgtggcacaatcactaaacgcgtcgggttttcgtgatccgattcatcgcgcaggtcgtccaccatcggcagttttttattgcgcatctgcgcagcaatctgctccagcacttttgcgccagatacctgatgcggcaacgcggtgatcaccacggcgccgtcttctttggtccataccgcgcgcatacgcacggagccacgcccattttcgtaaattttacgaatttccgcacgagggataatgatctccgcttcggtcgggtaatccggcccctggacgatatccagcaactgatccagcgtcgttttcggctgctcaatcagcgtaatcgccgctttcgcgacttcgcgcaggttatgcggcggaatatctgttgccatgcccaccgcaataccggtggtgccgttcagcaggatgttcggcagacgcgccggtaacattttcggttcctgcatggtgccgtcgaagtttggcacccagtccgcagtcccctgaccgagttcgcttaacagcagctcggcgtatttggacaggcgggattcggtataacgcatcgccgcgaatgacttcggatcatccggcgcgccccaattcccctggccatcgaccagcgggtaacggtaagagaacggctgcgccatcagcaccatggcttcatagcaggcgctgtcgccatgcgggtgatacttacccagtacgtcgccaacggtacgggcggattttttaaatttagcggtggcgttcagccccagctctgacatcgcatagacgatgcggcgctgtaccggcttcaggccgtcgccaataaacggcaacgcacgatccatgatcacgtacatggagtagtttaagtaggcgttttccgtaaattcatgtagcgcaaggcgctctgccatatcgctcattaacaggggatcctcaatctgcatgctgaccgttcggacggcaatattgccgcagataataccctatctcacggtctgagtcacaaaccgtgagacaggttgcgaggaagttaacgaagcggcagatagatatccgtcagcagctcatgttccgccacctcatggacgaaattcaggtactggaagaagaccggaaaatcgcgcagcgtctcgccgctggccggtagccattcgcggaataaataccacacgctctccgggaggctgtcgagcgatccctgatggcgcaccaccgcgcagcgcccgccaggaatctcgctattcaccacgccaacgtcattttcggctatcggctggcggacgctgccgcagatatcaaagcggaattgagccggcggcgtcgtctgcgggtcgtgccaggcaataccaaaagtttgactgctggcaatcggcgactggcccgtttcgcgtcgccatgcaataaatttcgccgcgctggcgttgaccttatccggatgccccagatgcgtcagcatcgcgacgcgggtaggaggaaattcaacgatttttacgtccatgacatgctgctcctgtaacgcaagtttaggaacgcgttggtgccaggccagccagtccggcgattgccgaaaccggcacgggctttgaccaaacgcggttttgaaagcacgtgtgaacgactccggattctgaaatccggcatccagcgcgatatcgataactttatcttgcggattaaacgccagccgccatgacgcccggcgcaaacgcagccactggatatagcgatagagcggaagcccgctccagacggtaaactgccggtgaaaatgaaacggcgagctgtgcgccatccggcttaacgcctcaagcgacagaggctcatccagatgacgctcaatgtggtcgcaaacgcgccgcagacgttcggaataagccgcgctgatcaggtcattcatcactgcctccttgtggcctattctgcccaccgggcggctgtgaatcctgaccgatcttgcgcaatgtgggattacggattcactttacgaatctgtttcacgtcgatttcgacagagttccagtctttatccacttcaccctgaatttcaacggtatcctgcggggttacggtcaggccgttccagcgcttgtggtcaatgtccacattgatagtaccggtcgcatctttaaacacatacaggtcgtcggaaatgcgctcgacgatattcccgcgcagcgttacccacgcatcgtcacgcagcgatttagcgctctctaccgtcgtgctgctgccgttcgggccgacaaatccgccgccctgcgtttgcgtcgccgacgggccggagaaaccgccctgctgagccgccagaaccggggtagaacacagtgccataacggcaacgattgcagctaattttttcatgattacttttccctttcatgtcgtttcagatccatttaataaggtaatccttaacaacttcttaaggcaaaaaaagattctttttttctgtacatcgcctgcggcgacaaggttaactgacggcaacgcgagttaccgcagggaagaacagatgcgaattttactggtagaagatgacacacttattggcgatggcataaaagcaggtctgagtaaaatgggtttcagcgtcgactggtttaccgagggacgtccgggcaaagaggcgctttacagcgcgccttatgatgcggtcattttagatttaacgctgccaggaatggacggacgggatattttgcgcgaatggcgcgaaaagggtaaacaggaaccagtactgatcctgacggcgcgcgacgcgttagcagagcgcgtcgaggggctacgtctgggcgccgatgactatttatgtaaacctttcgcgctcattgaggtcgccgcccgtctggaggcgctggtacgccgcgccagcggtcaggccagtagcgaattgcgccacggccaggtgacgctcaatccaggcaatctcgtcgcgacgcttgccggcgaaccgctggccctaaaaccaaaagagttcgcgttgctggaactcttactgcgcaacaaaggtcgcgtgctaccgcgcaagcttattgaagagaagctgtataactgggatgacgacgtgtccagcaatgcagtggaagtccatgttcatcatttacgccgcaagctcggcagcgaatttattcgcaccgtacacggcatcggctacaccctgggtgacgcatgaaattgacgcaacgtctcagcctgcgcgtcaggctgacgcttattttcctgattctggtctccatcacctgggcaatttccagttttgtggcctggagaaagacgacggataatgtcgatgagctgtttgacacacagttgatgttgttcgccagacggcttagcaccctcgatcttaacgagctcaacgccccgcagcgcatggcgcatacgccaaagaaattaaaacatgggcatatcgatgacgatgcgctggcgttcgccatcttttccgctgacggcaaaatgttgctgcatgatggcgacaacggccaggatattccgtatcgctatcgccgggaaggtttcgacaatggctatctgaaggatgacaacgacctctggcgttttttgtggttgaactcggcggacggcaagtatcgtatcgtcgtcggtcaggagtgggattaccgcgaagatatggcgctggcgatcgtggcggcgcaattaacgccgtggctgatcgcccttcccttcatgctgctgattttattactcctgcttcaccgcgagctcagaccgttgaaaaaactggcgcaggcgctgcgcttccggtcgccggaatcggaaacgccgctcgacgccaaaggcgtaccgagcgaggttcgcccactggtcgaagcgcttaatcagctttttagccgcatccactccatgatggtgcgcgaacggcgatttacctccgacgccgcccatgaattgcgcagcccgctggccgcgctgaaagtacaaaccgaggtggcgcagctctcgggcgacgatccgctatcgcgtgataaagcgctgacccagctccatgcggggatcgatcgcgccacgcggctggtcgatcagctactgacgttatcgcgtctcgactcgctcaataatttgcaggatgtagcggagatttcgctggaagagctgctgcagtccgcggtaatggatatttatcatccggcgcagcaggcgaatatcgacgtgcgtttacagcttaacgcccatgacgtcatacgtaccggccagccgctactcttaagcctgttagtgcgtaacctgctggataatgcgattcgctacagtccgcagggcagcgtcgtcgacgttaccttacatgcccgcagcttcaccgtcagagataatggccccggcgtagcgccagagattctaacgcatatcggcgagcgtttttaccgcccgccaggccaaagtgtgaccggcagcggtctgggattatcaatcgtccgccgcatcgctacgctgcacggcatgacggtgtcgtttggcaacgccgcggaaggtggatttgaggccgtagtacgctggtagcagagatttttgccaaaaacgcaaaagactttgcacattttgctaatttcaccgcaccgcccgtcagcgtagaatcagcagcaaacgcatttcttgaggacacaaaatgagtaacatcctgattatcaacggggcgaaaaaattcgcgcactccaacggccagttgaatgacaccctgaccgaagttgccgatgggctgctgcgcgatctgggtcatcaggttaagatcgtccgcgccgacagcgactatgacattaaagaagaggtgcagaatttcgtctgggctgacgtggtgatttggcagatgccaggctggtggatgggcgcgccatggacagtaaaaaatatatggatgatgtctttaccgaaggtcacggcacgctctatgccagcgatggccgcacgcgttccgatgccgctaaaaagtacggttccggcggtctggtgcaggggaaaaaatatatgctgtcactgacgtggaacgcgccgatggaagcatttaccgaaaaagatcagtttttccacggcgtaggcgtagatggcgtctatctgccattccataaagccaaccagttcctgggcatggacgcgctgccaacgtttattgccaacgacgtgattaaaatgccggatgttccgcgctataccgcagaatatcgcaagcatcttagcgaaatttttgcttaactggtcatcctggaattagaaggagttaaccatgcttaccgtcattgccgaaattcgcacgcgtccgggccaacatcaccgtcaggccgtcctcgatcagtttgcgaaaattattccaaccgttcttaaagaagaggggtgccacggttacgcgccgatggtggatcatgccgcgggcgtgagttttcagactctggcgcctgactcgatcgtgatgattgaacagtgggaaagcgttgcgcaccttgaagcgcatctgcaaaccccgcatatgaaagcctatagcgacgcggtaaaagacgatgtgctggaaatgaatattcgtattctggaatccggcgtttaagttattaccctcgtctgacgtcgccctgatgcgatgcgcaagtgtcgccatcaggctgcgacgtcatgtcggattctcttatccggcctgcggcgcgcagaccggataaagcgtgcaacaatcgttacacgtcgagatccgcgagatcgcctttttcctgtagccagttgcgtcgatcttcagaacgtttcttcgccagcagcatatccatcatcgcattagtacgctgatcgtcttcatcgctaatggtgagctgcaccaggcggcgagtattcggatcaagcgtggtttcgcgtaactgcatcgggttcatttcacccaggcctttgaaacgctggacgttcggcttgcctttcttacgcttcagttgttccagtacgcccgccttctcttcttccgtcagcgcgtaatagacctctttacccaaatcgatacggtatagcggcggtagcgcgacgtagacatgaccattcttcaccagcgcgcggaagtgtctgacaaacagcgcgcaaagcagagtagcgatatgcaaaccatcggagtccgcatccgccaggatacagatcttgccgtagcgcagctgactcagatcgtcgctgtccggatcgataccgatcgccacggaaatatcatgcacctcttgcgaggccagcacttcatcggaagagacttcccaggtgttaaggatcttacctttgagcggcatgatcgcctgatattcgcgatcgcgcgcctgcttggcggaaccgcctgccgaatccccttccacaaggaacagctcggttcgattaagatcctgcgcggtacagtccgccagtttccccggcaacgccggaccgctggtgagttttttgcgtaccactttttttgcggcgcgcagtcgccgctgcgcgctggcaatcgccatctctgccagttgttccgccgcctgcacgttctggttcagccacaggctgaaggcatctttcaccacgccggaaacaaatgccgcacattgacgcgacgacagacgctctttggtctgcccggcaaattgcgggtcctgcattttcacggagagcacataagcgcagcgatcccagatatcttccgccgacagtttgacgccgcgcggcagaatattgcggtattcgcaaaattcgcgcatcgcgtcgagcaggccctggcgcagaccgttgacgtgcgtccccccctgcatggtcgggatcaggttgacgtagctttccgtcagtaattcgccgccttccggcagccacaatagcgcccagtcaaccgcttccgtttcaccgttaaaattaccgataaacggcttttccggcagcgtcggcaggccgtttaccgcttcgcccagatagtcgttcagaccatcctggtagcaccagcgctgctcgctgttattcacttcatctttaaaagtgatttccacgccgggacacagcaccgcttttgctttcagaacgtgcattaagcgagagacagaaaaacgcgggctgtcgaagaaactttcgtccggccagaaatggacgctggtgccagtattacgtttaccgcaggtgccgacaacctgcaaatcctgcactttttcgccgttttcaaacgcgatgttatagacctgaccgtcgcggcgcacggtcacttccacgcgctttgacagggcattcacgaccgaaatccccaccccatgcagaccaccagagaactgatagttcttattggagaatttaccgccggcatgaagccgacagaggatcagttctaccgccggaaccccctcttccggatggatatccaccggcatcccgcgtccgtcgtcaatcacttccagcgattgatcggcatgtaaaatgacatccacgcgtttggcgtgacctgccagtgcttcatccacactattatcaattacttcctgacccaaatggttggggcgggtcgtatcggtgtacatccccgggcggcggcgtaccggctcaagcccagtgagtacctcaatggcatcagcgttataagtttgcgtcatggtttaattagcaattcgaattgattgtcagcaactgtgcagtccaagaaaatcgacaatctggttgaaataatcttcgaagcccgtgaatgcgtgattacccccctcggtcactgtctgacggcaggaggcgtaatatgccaccgcctggcggtaatccagcacttcatcgcccgtctgttgcagtagccagatcaggtccggcgcttccagcgggtcaatctgcatgactttaagatcataaatatggcgagactctagcacatattgctgcccggtgtaggggttctcgttctgaccgagatagtcggtcagtaattcaaagggccgcacggcgggattcaccaccacagccggcagcataaaacattgcgacagccaggtggcgtaataaccacccagcgacgatcctaccagccctaatggcgcaccgccatgctcaagtacgagagattccagcaactccgccgcatcggcaggatacggcggcagttgagggacgatcatctcaacatgcggatgacgctccgccagccagttttttagctggcacgcttttgccgagcgaggggaactgttgaatccgtgcaaatagagaagcgtagacatcagtatccttccgaagcggtatcgggtcggaaccgggtatcctgcaggcgatgcacttccgtctccaggacgccgttcgcctggagctccagcgtacgccagcccggcgcgatagtatccagcgtaaagttcgcgcagtgcggtttgaactgtacgcaggttgacggcgacgccaacagacggcgaccgttccagtcgagatccagctcctggtgaatatgtccgcatagcagatactttacacgcgggaaattcgccagcacgctatccagctcaccagcattacgcaagctgtgctgatccagccaactgcaccctgccggcaacggatggtggtgcaacaggagcaatgtctgtctctctggcgcatcggcgagcttacgctcaagccattccagttggaactcgctcagttcgccatgcgggacgccaaacacctggctatccagcaacaaaatctgccattgttcaccgattaacacgcgtttagccggggaaatccccgcctcttgcagcgcgctgtacattgccggctgaaaatcgtgattgcccggtagccaaacgcaaggcgcgcgaaagcttgcgataccctcagcaaaatgctgataagccgcagcggattgatcctgcgccagatcgccggtcgccacgatcagatcatattcatactgttgcgcccgaatagcctccagcacggcctggtaactttcccaggtattgacgcctaacagcgtttcatgcttttcggcaaacaggtgagtatctgtaatttgtaaaatcctgactcgggcctcaccagccagaggtagggttaacaggctttccaaatggtgtccttaggtttcacgacgctaataaaccggaatcgccatcgctccatgtgctaaacagaatcgtagccagtcggccagaaactgattaatttgatgcttttcgtcgcgttgatgcaactttttatttggataatcataccgcgctttgaagcgaaagatctgctggcttgaacacacttcagccaccatcgcatcatggtagaggcgcaccgtcagcgacggcaggctccagtaggtgatggctggcgccgtttgctcgatcgttacaagcgtagtgtatcgggtcaattccacaatcgttaaccgatattgtacgttgcccacctgatagctcaccgtttcaccgggggcgtcattgcgcggcagcaggcggcgcaattgcgaaaaattggtttcgcacaaacgcatcatttctgggaagtcaggtgtataacgcttcattttttccactcgttttttaactcttgatgatgcaactgaagccattgcaaagcgatgactgcggctgcgttgtcgattttcccctcttctacccactggtatgcctgttcccggcttaccacatgaacccgaatatcttcgttttcatccgccagaccatgaatacctaccgcggtcgtggcgtccacttcacccaccagaatagatgagcgctcgctggttcctcctggactcgccaggtaactgatgaccggtcgggtgcggcctacggtcagccccgcttcttccatcgcctcccgccgggcgaccgcctcaatggtttcgccttcttctatcatgccggcgaccatctccagcagccacggcgtaacgcttgtgtcatatgcggcaatacgaatctgttcgaccagcaccacctcgtcgcgttcagggtcaaagggtagcaagacggcggcgtgcccgcgctcaaaaatttcgcgctttacctcgccactcatttctccgttgaataaacgatggcggaatcgatacacatccaatgaaaaaaaaccgcgatagcgcgtttcccgtgcaataatttctacatcgcttttggtgaaagtaactggcaagttgtctgatttacgcattgtgctgccctgctagcaataatgattaaatgatgaatttcaagggtggttgactgctgttttatcacccttgtggtaaattggtgccaattaaggctcgtatggcacgtaacgccaactttttgcagtggcggattctgctagaatcagcaattatttttacaaattgatcagcgctaaatactgcttcacaacaaggaatgcaaatgaagaaattgctccccatccttatcggcctgagcctgtcggggttcagcacactaagccaggcagagaacctgatgcaagtttatcagcaagcacgcctgagcaacccggaattgcgtaaatccgctgccgatcgcgatgctgcattcgaaaaaattaacgaagcacgtagtcctttactgccgcaactgggtttaggtgccgactacacctacagcaacggttatcgcgatgcgaacggtatcaactccaatgaaaccagcgcttctctgcaattaacgcagacgctatttgatatgtcgaaatggcgtgggctcaccctgcaagaaaaagcagcaggcattcaggatgtcacctatcagaccgatcagcagacgctgatcctcaataccgcgaacgcgtattttaaggtattgaacgctattgatgtgctttcctatacccaggcgcaaaaagaggctatctaccgtcagttagatcaaacgacgcaacgttttaacgtgggtctggtcgccattaccgacgtgcaaaacgcccgtgcgcaatatgataccgtactggcgaatgaagtgaccgcccgcaacaacctggataacgcggtagaagagctgcgccaggtaaccggcaattattacccggagctggcgtcgcttaacgtcgagcattttaaaaccgacaaacccaaagctgttaatgcgctgctgaaggaagcggaaaaccgtaacctgtcgctgttgcaggcgcgtttaagtcaggatctggcgcgcgagcaaatccgtcaggcgcaggatggtcatctgccgacgctgaatttaacggcctcaaccggcatttctgatacctcttatagcggttctaaaaccaactccgcccagtacgacgatagcaacatggggcagaataaaatcggcctgaacttctccctgccgctgtatcaaggcgggatggttaactcgcaggtaaaacaggcgcagtataacttcgtcggcgcaagcgaacagctggaaagcgcgcaccgtagcgtggtgcagaccgtacgttcttcctttaacaatattaacgcctccatcagcagcatcaacgcgtataaacaggcagtcgtttccgcgcaaagttctttggatgcaatggaagccggttactcggtcggtacacgtaccattgttgacgtactggatgccaccaccactctgtatgatgccaagcagcaactggccaacgcgcgttatacctatttgattaatcagttaaatatcaaatatgcgctcggtacgctgaacgagcaggatctgctcgcgcttaacagtacgttgggtaaacctatcccgacgtcgccggaaagcgtagcgccggaaacgccagagcaggatgctgccgcagacggttataatgcccatagcgccgcgccggcagtacagccgaccgccgctcgcgccaacagcaataacggcaatccattccggcattgataagttattcgctggcgctgcgtttatcagacctatgcccttgtaggtctggtaagcgcggcgctacctgtcataaagccgcgcctgaacgtaagacaacgtaaagatcctgctattccgccgcattctcgccttttctcgcttcaatttcgaccagtcatcctctattctgaacgcatgttgtatttaccactgggtcctggaagacaaatatgaaacggacaaaatccatccatcacgcatcatttcgcaaaagctggagcgcgcggcatttaacgccggtcgccctggcggttacggctgtttttatgctggctggctgtgaaaaaagcgatgaaaccgtatcgctgtatcaaaacgctgatgactgttcagcggcgaatccgggcaaaagcgcggaatgtacaaccgcgtataacaatgcgctgaaagaggccgaacgtactgcgcctaagtacgctacacgcgaagattgcgtcgctgagtttggcgaaggccagtgccagcaagcgcccgcacaggctggcatggcgccggaaaatcaggcgcaggcccaacaatccagcggcagtttctggatgccgcttatggcaggttacatgatggggcgtctgatgggcggcggcgcaggctttgcgcaacagccgctgtttagctcgaaaaacccggccagccctgcatacggcaaatataccgatgcggcaggtaaaaactacggggcggcgcaaccgggccggacaatgaccgtaccgaaaaccgcgatggcgccgaaacctgccaccacaacaaccgttacccgcggcggttttggcgaatccgtcgccaaacagagcactatgcagcgtagcgctgccggtacttcaacacgttcgatgggcggctgatacgcatggaaagagtcagtattaccgagcgcccggactggcgcgataaagcgactgaatacgggtttaattttcacactatgtatggtgaaccgtactggtgtgaagacgcttattacaagttaacgctcgcccaggtggaaaaactggaagacgttaccgccgagctgcaccagatgtgcctcaaggtagtagaacgcgtcatcgccagcgatgagctgatgacgaagtttcgtattccaaaacatacctggggttttgttcgccagtcctggcaaacgcaacaaccgtcactctattcccgcctcgatttggcctgggacggcatcggcgagcctaagctgctcgaaaataatgccgacacgccaacatcgctgtatgaagcggcgttttttcagtggatttggctggaagatcagatcaacgcgggcaatctgccggaaggcagcgatcagtttaatagcctgcaggaaaagctgattgaacgctttgctgaacttcgcgaacagtacggttttcagttgctgcatctcacctgctgtcgcgatacggttgaggatcgcggcaccattcagtatttacaggattgcgcggccgaagcggaaatcgccaccgaatttctctatatcgacgatattggtctgggggaaaaaggtcaatttacggatctgcaggatcaggtcattgcgaacctgttcaagctctatccgtgggaatttatgctacgcgagatgttttccaccaagctggaagatgccggcgtgcgctggctggaaccggcctggaaaagcattatctccaataaagcgttattgccgctgttgtgggagatgttcccggaccatccgaatctgttgcctgcgtatttcgccgaagacgaacatccgccaatggataaatatgtcgtgaaaccgatcttctcccgcgaaggggcgaacgtatcgattattgagaacggtaaaacgatcgaatccgtggaaggcccgtatggcgaagagggtatgatcgtgcaacagttctatccgctgccaaaattcggcgacagttacaccctgattggtagctggctgattaacgatcaacccgccggaattggtatccgtgaagatcgggcactgatcacccaggatctctcccgcttctatccgcatatttttgtcgaaggatagattttcctgtaagcccgatgcgcgtagcgccatcgggcaatcattcagcgccttatccggcctaccccacctgcaccgacaacatacttatactgcccatctcaataccgtcgaccgggatggtgataggttccttgccgtcccaggcgccaagtacatacagcaaaggcaaaaagtgctccggcgtcgggttcgataaggcgcccccttcatgttgcagataattcaccagcgggtgctgttctaccggcccctgccacgtcaggttagctttcacaaagtcattaaatgacgccgcccagggatacggtatattgtcaccgtgccaacgcacagtccgcaggttatgaaccacattcccgctagccaccagcatcacgccttcgtcacgcagcgtcgccagtttacgacccatctcaaaatgccatgccgccggtttggtactatcaacactaagctgcaccatcgggatatccgcattcgggtacatcttgatcaatacgccccaggagccgtgatcaaatccccacgcctctttatcgagcgcgacgggaacgggagccaacagttcaaccagacgctgcgccagcgcaggcgatccaggggccggataatgcatgtcatacagcgcctgcggaaaaccgccaaaatcgtggagagtttgcggcctttccatcgctgtgacgcccgtcccacgggtataccagtgcgccgacaccaccactatcgcctgtggtcgcggtagggcttcccccaatcgccgccaggcgcgggtataatcattatcgtccagcacgttcatcgggctgccatgccccaaaaacaatgctggcatacacgttaaagacatgatgctatccttacaggaaagacattttgttaacatcaccatacgctttcttcacagaggaagaactcagataactatgatgaagatcatcagttattttgaaggtcaggttcggacggcaaattgataaggagtaatggatgtcagtaccacttattctgaccttactggcgggcgctgccacctttattggcgcgtttcttggcgttcttggccaaaaaccgtctaaccgcgtgctggctttttcgctgggcttcgccgcagggatcatgctgctcatctcgctgatggagatgctgcccgccgcgttagataccgaggggatgtcgcctgtactgggctacgggatgtttattatcggcctgttgggctacttcgggctggatcgtctgcttcctcacgctcatccgcaggatctggtgcaaaaaaggcagcagccgcttcccggctcgataaaacgcactgcgattttattgacgctcggcattagcctgcacaactttccggaaggaatcgccacctttgtcactgccagcagcaatcttgaactgggtttcggcatcgcactggcggtggcgttgcacaatattcctgaagggctggcggttgccggcccggtttatgccgcgacgggctcaaaacgtaccgcgattttttgggccggtatctccggcatggcggaaattcttggcggcgtgctggcgtggctgattttgggcagcctggtttcaccgatcgttatggcggctatcatggcagcagtcgccggcattatggtggcgctctccgtcgatgaactgatgccgttggcaaaagagatcgatcctaacaataaccccagctatggtgtgctttgcggtatgtccatcatggggctcagtctcgtcattttgcagacgataggtatcggttaagagcaacgtcgcgccggatgcaggcctttagccaggcaacatccggctgcccgtcaaggatatgcgctatttctgctcattcatcacgctgtcgccttcgctcgtctggcgaaaacgtttcgttcgcgcttcaagtaatgcatctctgtcttgccgaaacgctctgca
